US009046530B2

(12) United States Patent
Zhong

(10) Patent No.: US 9,046,530 B2
(45) Date of Patent: Jun. 2, 2015

(54) METHODS AND COMPOSITIONS FOR CHLAMYDIAL ANTIGENS AS REAGENTS FOR DIAGNOSIS OF TUBAL FACTOR INFERTILITY AND CHLAMYDIAL INFECTION

(71) Applicant: Board of Regents, The University of Texas System, Austin, TX (US)

(72) Inventor: Guangming Zhong, San Antonio, TX (US)

(73) Assignee: Board of Regents, The University of Texas System, Austin, TX (US)

( * ) Notice: Subject to any disclaimer, the term of this patent is extended or adjusted under 35 U.S.C. 154(b) by 7 days.

(21) Appl. No.: 13/691,260

(22) Filed: Nov. 30, 2012

(65) Prior Publication Data

US 2013/0143757 A1    Jun. 6, 2013

Related U.S. Application Data

(60) Provisional application No. 61/566,089, filed on Dec. 2, 2011.

(51) Int. Cl.
*G01N 33/68* (2006.01)
*G01N 33/569* (2006.01)

(52) U.S. Cl.
CPC ...... *G01N 33/6893* (2013.01); *G01N 33/56927* (2013.01); *G01N 2800/367* (2013.01); *G01N 2800/52* (2013.01)

(58) Field of Classification Search
USPC .......................................................... 506/9
See application file for complete search history.

(56) References Cited

U.S. PATENT DOCUMENTS

| | | | |
|---|---|---|---|
| 7,892,567 B2 | 2/2011 | Arulanandam et al. | |
| 8,092,812 B2 | 1/2012 | Arulanandam et al. | |
| 2010/0119549 A1 | 5/2010 | Zhong | |
| 2011/0256094 A1 | 10/2011 | Zhong | |
| 2013/0045181 A1 | 2/2013 | Zhong | |

FOREIGN PATENT DOCUMENTS

WO    WO2010/100632 A2 *   9/2010   ............ A61K 39/118

OTHER PUBLICATIONS

Mouton et al, International Journal of STD and AIDS, 2002: 13 (Suppl. 2): 26-29.*
Bax et al. "Comparison of Serological Assays for Detection of *Chlamydia trachomatis* Antibodies in Different Groups of Obstetrical and Gynecological Patients" *Clinical and Diagnostic Laboratory Immunology* 10(1):174-176 (2003).
Budrys et al. "Genome-Wide Identification of *Chlamydia trachomatis* Antigens Associated with Tubal Factor Infertility"

Abstract from the American Society for Reproductive Medicine 67th Annual Meeting (Oct. 15-19, 2011) Orlando, Florida (2 pages).
Cappello et al. "*Chlamydia trachomatis* Infection and Anti-Hsp60 Immunity: The Two Sides of the Coin" *PLoS Pathogens* 5(8):e1000552 (2009).
Chen et al. "The Hypothetical Protein CT813 is Localized in the *Chlamydia trachomatis* Inclusion Membrane and is Immunogenic in Women Urogenitally Infected with *C. trachomatis*" *Infection and Immunity* 74(8):4826-4840 (2006).
Chen et al. "Characterization of Pgp3 a *Chlamydia trachomatis* Plasmid-Encoded Immunodominant Antigen" *Journal of Bacteriology* 192(22):6017-6024 (2010).
Claman et al. "The Presence of Serum Antibody to the Chlamydial Heat Shock Protein (CHSP60) as a Diagnostic Test for Tubal Factor Infertility" *Fertil Steril* 67(3):501-504 (1997).
Coppus et al. "*Chlamydia trachomatis* IgG Seropositivity is Associated with Lower Natural Conception Rates in Ovulatory Subfertile Women without Visible Tubal Pathology" *Human Reproduction* 26(11):3061-3067 (2011).
Den Hartog et al. "*Chlamydia trachomatis*-Associated Tubal Factor Subfertility: Immunogenetic Aspects and Serological Screening" *Human Reproduction Update* 12(6):719-730 (2006).
Fan et al. "*Chlamydia pneumoniae* Secretion of a Protease-Like Activity Factor for Degrading Host Cell Transcription Factors is Required for Major Histocompatibility Complex Antigen Expression" *Infection and Immunity* 70(1):345-349 (2002).
Fan et al. "Inhibition of Apoptosis in *Chlamydia*-Infected Cells: Blockade of Mitochondrial Cytochrome c Release and Caspase Activation" *J. Exp. Med.* 187(4):487-496 (1998).
Fling et al. CD8[+]T Cells Recognize an Inclusion Membrane-Associated Protein from the Vacuolar Pathogen *Chlamydia trachomatis* *PNAS* 98(3):1160-1165 (2001).
Gervassi et al. "Human CD8[+]T Cells Recognize the 60-kDa Cystein-Rich Outer Membrane Protein from *Chlamydia trachomatis*[1]" *The Journal of Immunology* 173:6905-6913 (2004).
Greene et al. "Inhibition of Host Cell Cytokinesis by *Chlamydia trachomatis* Infection" *Journal of Infection* 47:45-51 (2003).
Greene et al. "*Chlamydia*-Infected Cells Continue to Undergo Mitosis and Resist Induction of Apoptosis" *Infection and Immunity* 72(1):451-460 (2004).
Koh et al. "Seroprevalence of IgG Antibodies Against *Chlamydia pneumoniae* in Chinese, Malays and Asian Indians in Singapore" *International Journal of Epidemiology* 31:1001-1007 (2002).
Hower et al. "Evidence that CT694 is a Novel *Chlamydia trachomatis* T3S Substrate Capable of Functioning During Invasion or Early Cycle Development" *Molecular Microbiology* 72(6):1423-1437 (2009).
Lei et al. "Localization of *Chlamydia trachomatis* Hypothetical Protein CT311 in Host Cell Cytoplasm" *Microb Pathog.* 51(3):101-109 (2011).

(Continued)

*Primary Examiner* — Jennifer McDonald
*Assistant Examiner* — Valerie Toodle
(74) *Attorney, Agent, or Firm* — Myers Bigel Sibley & Sajovec, P.A.

(57) ABSTRACT

The present invention provides *Chlamydia* proteins and fragments thereof and methods of use in diagnostic assays.

7 Claims, 6 Drawing Sheets

(56) References Cited

OTHER PUBLICATIONS

Li et al. "Characterization of Fifty Putative Inclusion Membrane Proteins Encoded in the *Chlamydia trachomatis* Genome" *Infection and Immunity* 76(6): 2746-2757 (2008).

Li et al. "The Chlamydial Plasmid-Encoded Protein pgp3 is Secreted into the Cytosol of *Chlamydia*-Infected Cells" *Infection and Immunity* 76(8):3415-3428 (2008).

Logan et al. "Can History, Ultrasound, or ELISA Chlamydial Antibodies, Alone or in Combination, Predict Tubal Factor Infertility in Subfertile Women?" *Human Reproduction* 18(11):2350-2356 (2003).

Peeling et al. "Antibody to Chlamydial hsp60 Predicts an Increased Risk for Chlamydial Pelvic Inflammatory Disease" *The Journal of Infectious Diseases* 175:1153-1158 (1997).

Qi et al. "A *Chlamydia trachomatis* OmcB C-Terminal Fragment is Released into the Host Cell Cytoplasm and is Immunogenic in Humans" *Infection and Immunity* 79(6):2193-2203 (2011).

Ridker et al. "Prospective Study of *Chlamydia pneumoniae* IgG Seropositivity and Risks of Future Myocardial Infarction" *Circulation* 99:1161-1164 (1999).

Rodgers et al. "Association of Tubal Factor Infertility with Elevated Antibodies to *Chlamydia trachomatis* Caseinolytic Protease P" *Am J Obstet Gynecol.* 203(5):494.e7-494.e14 (2010).

Rodgers et al. "Genome-Wide Identification of *Chlamydia trachomatis* Antigens Associated with Tubal Factor Infertility" *Fertil Steril.* 96(3):715-721 (2011).

Sharma et al. "Human Antibody Responses to a *Chlamydia*-Secreted Protease Factor" *Infection and Immunity* 72(12):7164-7171 (2004).

Sharma et al. "Profiling of Human Antibody Responses to *Chlamydia trachomatis* Urogenital Tract Infection Using Microplates Arrayed with 156 Chlamydial Fusion Proteins" *Infection and Immunity* 74(3):1490-1499 (2006).

Stephens et al. "Antichlamydial Antibodies, Human Fertility, and Pregnancy Wastage" *Infect Dis Obstet Gynecol* vol. 2011, Article ID 525182 (9 pages) (2011).

Veenemans et al. "The Value of *Chlamydia trachomatis* Antibody Testing in Predicting Tubal Factor Infertility" *Human Reproduction* 17(3):695-698 (2002).

Wang et al. "A Genome-Wide Profiling of the Humoral Immune Response to *Chlamydia trachomatis* Infection Reveals Vaccine Candidate Antigens Expressed in Humans" *The Journal of Immunology* 185:1670-1680 (2010).

Zhong et al. "Identification of a Chlamydial Protease-Like Activity Factor Responsible for the Degradation of Host Transcription Factors" *J. Exp. Med.* 193(8):935-942 (2001).

Ault et al. "Antibodies to the Chlamydial 60 Kilodalton Heat Shock Protein in Women with Tubal Factor Infertility" *Dis. Obstet. and Gynecol.* 6:163-167 (1998).

Barlow et al. "The Prevalence of *Chlamydia trachomatis* in Fresh Tissue Specimens from Patients with Ectopic Pregnancy or Tubal Factor Infertility as Determined by PCR and in-situ Hybridisation" *J. Med. Microbiol.* 50:902-908 (2001).

Beatty et al. "Repeated and Persistent Infection with *Chlamydia* and the Development of Chronic Inflammation and Disease" *Trends in Microbiology* 2(3):94-98 (1994).

Brunham et al. *Chlamydia trachomatis*: Its Role in Tubal Infertility *The Journal of Infectious Diseases* 152(6):1275-1282 (1985).

Budrys et al. "*Chlamydia trachomatis* Antigens Recognized in Women with Tubal Factor Infertility, Normal Fertility, and Acute Infection" *Obstet Gynecol* 119:1009-1016 (2012).

Bulut et al. "Chlamydial Heat Shock Protein 60 Activates Macrophages and Endothelial Cells Through Toll-Like Receptor 4 and MD2 in a MyD88-Dependent Pathway" *The Journal of Immunology* 168:1435-1440 (2002).

Campanella et al. "A Comparative Analysis of the Products of GROEL-1 Gene from *Chlamydia trachomatis* Serovar D and the HSP60 var1 Transcript from *Homo sapiens* Suggests a Possible Autoimmune Response" *International Journal of Immunogenetics* 36:73-78 (2008).

Cheng et al. "Intracellular Interleukin-1α Mediates Interleukin-8 Production Induced by *Chlamydia trachomatis* Infection via a Mechanism Independent of Type I Interleukin-1 Receptor" *Infection and Immunity* 76(3):942-951 (2008).

Cheng et al. "Caspase-1 Contributes to *Chlamydia trachomatis*-Induced Upper Urogenital Tract Inflammatory Pathologies without Affecting the Course of Infection" *Infection and Immunity* 76(2):515-522 (2008).

Confino et al. "Transcervical Balloon Tuboplasty" *JAMA* 264(16):2079-2082 (1990).

Dadamessi et al. "Combined Detection of *Chlamydia trachomatis*-Specific Antibodies Against the 10 and 60-kDa Heat Shock Proteins as a Diagnostic Tool for Tubal Factor Infertility: Results from a Case-Control Study in Cameroon" *FEMS Immunology and Medical Microbiology* 45:31-35 (2005).

Den Hartog et al. "Screening Strategies for Tubal Factor Subfertility" *Human Reproduction* 23(8):1840-1848 (2008).

Dieterle et al, "Humoral Immune Response to the Chlamydial Heat Shock Proteins hsp60 and hsp70 in *Chlamydia*-Associated Chronic Salpingitis with Tubal Occlusion" *Human Reproduction* 11(6):1352-1356 (1996).

Domeika et al. "Humoral Immune Response to Conserved Epitopes of *Chlamydia trachomatis* and Human 60-kDa Heat-Shock Protein in Women with Pelvic Inflammatory Disease" *The Journal of Infectious Diseases* 177:714-719 (1998).

Dutta et al. "*Chlamydia trachomatis*-Specific Heat Shock Proteins 60 Antibodies Can Serve as Prognostic Marker in Secondary Infertile Women" *Infection* 36(4):374-378 (2008).

El Hakim et al. "Significance of Positive *Chlamydia* Serology in Women with Normal-Looking Fallopian Tubes" *RBMOnline* 19(6):847-851 (2009).

Equils et al. "*Chlamydia* Heat Shock Protein 60 Induces Trophoblast Apoptosis Through TLR4[1,2]" *The Journal of Immunology* 177:1257-1263 (2006).

Gijsen et al. "*Chlamydia pneumoniae* and Screening for Tubal Factor Subfertility" *Human Reproduction* 16(3):487-491 (2001).

Goodall et al. "Identification of *Chlamydia trachomatis* Antigens Recognized by Human CD4[+] T Lymphocytes by Screening an Expression Library" *Eur. J. Immunol.* 31:1513-1522 (2001).

Haggerty "Evidence for a Role of *Mycoplasma genitalium* in Pelvic Inflammatory Disease" *Current Opinion in Infectious Diseases* 21:65-69 (2008).

Healy et al. "Female Infertility: Causes and Treatment" *The Lancet* 343:1539-1544 (1994).

Hjelholt et al. "Tubal Factor Infertility is Associated with Antibodies Against *Chlamydia trachomatis* Heat Shock Protein 60 (HSP60) but not Human HSP60" *Human Reproduction* 26(8):2069-2076 (2011).

Jakus et al. "Antibody to the *Chlamydia trachomatis* 60 kDa Heat Shock Protein in Follicular Fluid and in Vitro Fertilization Outcome" *American Journal of Reproductive Immunology* 59:85-89 (2008).

Karinen et al. "Association Between *Chlamydia trachomatis* Antibodies and Subfertility in the Northern Finland Birth Cohort 1966 (NFBC 1966), at the Age of 31 Years" *Epidemiol. Infect.* 132:977-984 (2004).

Karinen et al. "Antibodies to *Chlamydia trachomatis* Heat Shock Proteins Hsp60 and Hsp10 and Subfertility in General Population at Age 31" *AJRI* 52:291-297 (2004).

Kinnunen et al. "Chlamydial Heat Shock Protein 60-Specific T Cells in Inflamed Salpingeal Tissue" *Fertility and Sterility* 77(1):162-166 (2002).

Kinnunen et al. "Heat Shock Protein 60 Specific T-Cell Response in Chlamydial Infections" *Scand. J. Immunol.* 54:76-81 (2001).

Laverda et al. "Chlamydial Heat Shock Proteins and Disease Pathology: New Paradigms for Old Problems?" *Infect. Dis. Obstet. Gynecol.* 7:64-71 (1999).

Moreno et al. "Immunopathogenic Consequences of *Chlamydia trachomatis* 60 kDa Heat Shock Protein Expression in the Female Reproductive Tract" *Cell Stress and Chaperones* 15:467-473 (2010).

Lunenfeld et al. "The Association Between Chlamydial-Specific IgG and IgA Antibodies and Pregnancy Outcome in an In Vitro Fertilization Program" *Journal of in Vitro Fertilization and Embryo Transfer* 6(4):222-227 (1989).

(56) References Cited

OTHER PUBLICATIONS

Malik et al. "*Chlamydia trachomatis* Infection in Women with Secondary Infertility" *Fertility and Sterility* 91(1):91-95 (2009).

Mol et al. "The Accuracy of Serum Chlamydial Antibodies in the Diagnosis of Tubal Pathology: a Meta-Analysis" *Fertil Steril* 67(6):1031-1037 (1997).

Morales et al. "Infection of Human Fallopian Tube Epithelial Cells with *Neisseria gonorrhoeae* Protects Cells from Tumor Necrosis Factor Alpha-Induced Apoptosis" *Infection and Immunity* 74(6):3643-3650 (2006).

Mygind et al. "Analysis of the Humoral Immune Response to *Chlamydia* Outer Membrane Protein 2" *Clinical and Diagnostic Laboratory Immunology* 5(3):313-318 (1998).

Pellati et al. "Genital Tract Infections and Infertility" *Reproductive Biology* 140:3-11 (2008).

Persson et al. "Antibodies to *Chlamydia trachomatis* Heat Shock Proteins in Women with Tubal Factor Infertility are Associated with Prior Infection by *C. trachomatis* but not by *C. pneumoniae*" *Human Reproduction* 14(8):1969-1973 (1999).

Sarov et al. "*Chlamydia* Specific IgG and IgA Antibodies in Women with Obstructive Infertility as Determined by Immunoblotting and Immunoperoxidase Assays" *Eur. J. Epidemiol.* 4(2):216-223 (1988).

Stephens "The Cellular Paradigm of Chlamydial Pathogenesis" *Trends in Microbiology* 11(1):44-51 (2003).

Svenstrup et al. "*Mycoplasma genitalim, Chlamydia trachomatis*, and Tubal Factor Infertility—a Prospective Study" *Fertility and Sterility* 90(3):513-520 (2008).

Sziller et al. "Circulating Antibodies to a Conserved Epitope of the *Chlamydia trachomatis* 60-kDa Heat Shock Protein is Associated with Decreased Spontaneous Fertility Rate in Ectopic Pregnant Women Treated by Salpingectomy" *Am J Reprod Immunol* 59:99-104 (2008).

Tiitinen et al. "*Chlamydia trachomatis* and Chlamydial Heat Shock Protein 60-Specific Antibody and Cell-Mediated Responses Predict Tubal Factor Infertility" *Human Reproduction* 21(6):1533-1538 (2006).

Westrom et al. "Pelvic Inflammatory Disease and Fertility. A Cohort Study of 1,844 Women with Laparoscopically Verified Disease and 657 Control Women with Normal Laparoscopic Results" *Sex Transm Dis* 19:185-192 (1992).

Toye et al. "Association Between Antibody to the Chlamydial Heat-Shock Protein and Tubal Infertility" *The Journal of Infectious Diseases* 168(5):1236-1240 (1993).

Wang et al. "A *Chlamydial* Type III-Secreted Effector Protein (Tarp) is Predominantly Recognized by Antibodies from Humans Infected with *Chlamydia trachomatis* and Induces Protective Immunity Against Upper Genital Tract Pathologies in Mice" *Vaccine* 27:2967-2980 (2009).

Wilkowska-Trojniel et al. "*Chlamydia trachomatis* Urogenital Infection in Women with Infertility" *Advances in Medical Sciences* 54(1):82-85 (2009).

Witkin et al. "Cell-Mediated Immune Response to the Recombinant 57-kDa Heat-Shock Protein of *Chlamydia trachomatis* in Women with Salpingitis" *The Journal of Infectious Diseases* 167(6):1379-1383 (1993).

\* cited by examiner

| CT ORF | | CT110 | CT376 | CT111 | CT557 | CT579 |
|---|---|---|---|---|---|---|
| TFI | Total | 24 | 24 | 24 | 24 | 24 |
| | +Ve | 9 | 6 | 4 | 4 | 4 |
| FC | Total | 25 | 25 | 25 | 25 | 25 |
| | +Ve | 0 | 0 | 0 | 0 | 0 |

Summary

B

*14 out of 24 (58%) TFI antisera reacted with CT110, CT376 or CT557

Positive Reactivity Distribution

24 TFI antisera

*C. trachomatis* ORF fusion proteins used for reacting with human antisera

Comparison of a potential chlamydia Ab test with HSG for identifying tubal factor fertility (TFI)

METHODS AND COMPOSITIONS FOR CHLAMYDIAL ANTIGENS AS REAGENTS FOR DIAGNOSIS OF TUBAL FACTOR INFERTILITY AND CHLAMYDIAL INFECTION

STATEMENT OF PRIORITY

This application claims the benefit, under 35 U.S.C. §119 (e), of U.S. Provisional Application Ser. No. 61/566,089, filed Dec. 2, 2011, the entire contents of which are incorporated by reference herein.

STATEMENT OF GOVERNMENT SUPPORT

The present invention was funded in part by government support under grant numbers R01AI064537 and R01AI047997 from the National Institutes of Health. The United States Government has certain rights in this invention.

STATEMENT REGARDING ELECTRONIC FILING OF A SEQUENCE LISTING

A Sequence Listing in ASCII text format, submitted under 37 C.F.R. §1.821, entitled 9237-50_ST25.txt, 1,098,928 bytes in size, generated on Nov. 29, 2012 and filed via EFS-Web, is provided in lieu of a paper copy. This Sequence Listing is hereby incorporated herein by reference into the specification for its disclosures.

BACKGROUND OF THE INVENTION

1. Field of the Invention

The present invention relates to the field of diagnosis/determination of chlamydial infection and disease as well as diagnosis/determination of tubal factor infertility.

2. Background Art

Twenty-five to 35% of patients presenting for infertility evaluation have tubal disease (1-4). *Chlamydia trachomatis* is the primary sexually transmitted infection responsible for tubal factor infertility (TFI) (5-7) with *C. trachomatis* antibodies in approximately 70% of human patients (8). *C. trachomatis* infected cells produce inflammatory cytokines (9-10) which may contribute to upper genital tract inflammatory damage (11-13). Lunefeld et al. found that among patients undergoing in vitro fertilization, those with *C. trachomatis* antibodies had decreased pregnancy rates (14).

*C. trachomatis* infection is often asymptomatic so patient history cannot dictate the presence of tubal disease (15-16). Elevated titers of anti-*C. trachomatis* antibodies are associated with TFI, but detection of overall antibody levels lacks the sensitivity and specificity required for differential diagnosis (17).

The present invention provides chlamydial antigens that can be used to develop rapid and convenient means for diagnosing/determining tubal factor infertility, as well as chlamydial antigens that can be used to develop rapid and convenient means for diagnosing/determining acute chlamydial invention.

SUMMARY OF THE INVENTION

In one aspect, the present invention provides a method of diagnosing tubal factor infertility in a subject, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof, and *Chlamydia trachomatis* CT875 or an immunologically reactive fragment thereof; and (b) detecting formation of an antigen/antibody complex with each of the antigen of *Chlamydia trachomatis* CT443 or an immunologically reactive fragment thereof and the antigen of *Chlamydia trachomatis* CT381 or an immunologically reactive fragment thereof and detecting the absence of formation of an antigen/antibody complex (e.g., detecting no antigen/antibody complex) with the antigen of *Chlamydia trachomatis* CT875 or an immunologically reactive fragment thereof in the sample, thereby diagnosing tubal factor infertility in the subject.

Also provided herein is a method of identifying a subject as having an increased likelihood of having or developing tubal factor infertility, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or an immunologically reactive fragment thereof and the antigen of *Chlamydia trachomatis* CT381 or an immunologically reactive fragment thereof and detecting the absence of formation of an antigen/antibody complex (e.g., detecting no antigen/antibody complex) with the antigen of *Chlamydia trachomatis* CT875 or an immunologically reactive fragment thereof in the sample, thereby identifying the subject as having an increased likelihood of having or developing tubal factor infertility.

In further aspects, the present invention provides a method of diagnosing acute *Chlamydia trachomatis* infection in a subject, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby diagnosing acute *Chlamydia trachomatis* infection in the subject.

Additionally provided herein is a method of diagnosing acute *Chlamydia trachomatis* infection in a subject, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby diagnosing acute *Chlamydia trachomatis* infection in the subject.

The present invention also provides a method of identifying a subject as having an increased likelihood of having an acute *Chlamydia trachomatis* infection, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby identifying the subject as having an increased likelihood of having an acute *Chlamydia trachomatis* infection.

Additionally provided herein is a method of identifying a subject as having an increased likelihood of having an acute *Chlamydia trachomatis* infection, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby identifying the subject as having an increased likelihood of having an acute *Chlamydia trachomatis* infection.

Additionally provided herein is a method of identifying a subject for whom antibiotic therapy for *Chlamydia trachomatis* infection is likely to be or would be beneficial, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby identifying a subject for whom antibiotic therapy to treat *Chlamydia trachomatis* infection is likely to be or would be beneficial. The method above can further comprise the step of applying antibiotic therapy for *Chlamydia trachomatis* infection and/or anti-inflammatory treatment procedures to the subject.

Also provided herein is a method of identifying a subject for whom antibiotic therapy for *Chlamydia trachomatis* infection is likely to be or would be beneficial, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby identifying a subject for whom antibiotic therapy for *Chlamydia trachomatis* infection is likely to be or would be beneficial. The method above can further comprise the step of applying antibiotic therapy for *Chlamydia trachomatis* infection and/or anti-inflammatory treatment procedures to the subject.

In further aspects, the present invention provides a kit comprising a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof.

Additionally provided is a kit comprising a diagnostic panel comprising an antigen of *Chlamydia trachomatis* CT875 or immunologically reactive fragment thereof. In particular embodiments, a kit of this invention can further comprise an antigen of *Chlamydia trachomatis* CT147 or immunologically reactive fragment thereof.

BRIEF DESCRIPTION OF THE DRAWINGS

FIGS. 2A-B. Distribution Patterns of Reactivity of 5 Antigens with 24 TFI Samples. The reactivity of each of 5 antigens (listed along the X-axis at the top of bottom) with 24 TFI and 25 FC human sera (each at a final dilution of 1:1000) was summarized in panel A and the reactivity with the 24 TFI samples (listed along Y-axis) was displayed in panel B. Each horizontal bar indicates a positive reactivity as determined based on the mean plus 2 standard deviations. Star indicates antisera uniquely reacted with a given antigen. Please note that CT110, CT376 & CT557 together positively detected a total of 14 unique TFI antisera (58%).

DETAILED DESCRIPTION OF THE INVENTION

Figure 1:
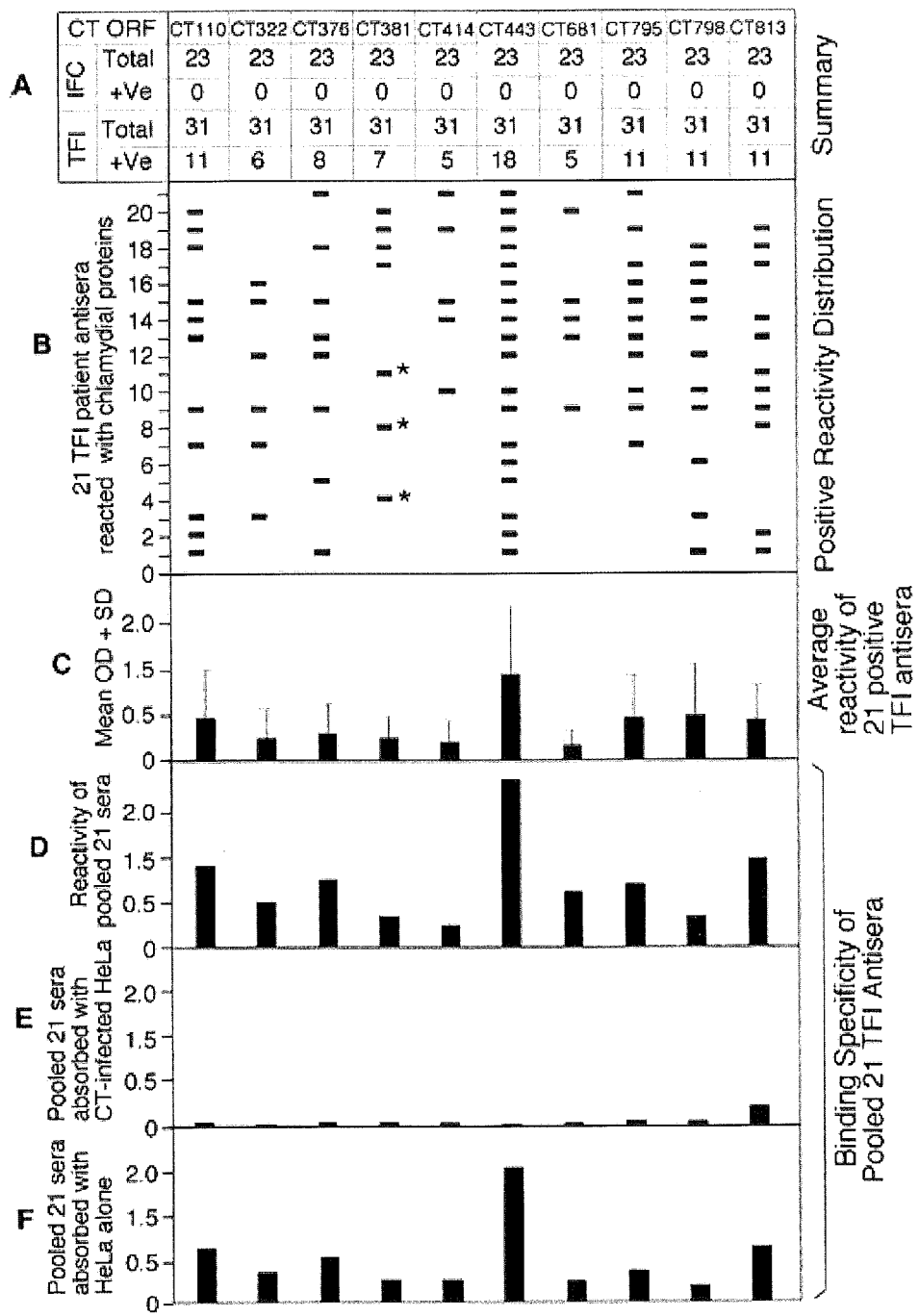
FIGS. 1A-F. Reactivity of 30 *C. trachomatis* Antigens with 54 Patient Sera at 1:4000 Dilution. The 30 antigens were reacted with the 54 human sera as described in Table 2 except that each serum was diluted 1:4000 (data not shown). (A) Ten of the 30 antigens, failing to react with any of the 23 IFC sera, were thus presented in the figure. Note that HSP60 (CT110) and OmcB (CT443) maintained a detection sensitivity of 35.5% and 58%, respectively. (B) The reactivity of each of the 10 antigens was analyzed at individual antiserum level. Note that the combinations of CT443 with CT381 or HSP60 with CT376, CT381 and CT798 can have the highest sensitivity of 67.7% while maintaining 100% specificity. (C) The reactivity intensity between each antigen and the 21 positive sera (measured at individual antiserum level) was expressed as mean OD plus standard deviation, (D) Each of the 10 antigens was reacted with an antiserum sample pooled from the 21 sera at equal ratio without (D) or with absorption with *C. trachomatis* (CT)-infected HeLa lysate (E) or HeLa alone lysate (F). Note that absorption with CT-HeLa but not HeLa alone lysates removed the reactivity of each antigen with the pooled antiserum.

The present invention is based on the unexpected identification of immunodominant proteins of *Chlamydia trachomatis* and combinations thereof that allow for the diagnosis of tubal factor infertility as well as for the identification of subjects having an increased likelihood of having or developing tubal factor infertility. The present invention is also based on the unexpected identification of immunodominant proteins of *Chlamydia trachomatis* and combinations thereof that allow for the diagnosis of acute infection by *Chlamydia trachomatis*. These immunodominant proteins have been identified by the screening fusion protein arrays described herein in the EXAMPLES section. These immunodominant proteins, immunologically reactive fragments thereof and/or homologues of these proteins or immunologically reactive fragments thereof from other chlamydial species can be employed in methods of detection and diagnosis by identifying the presence of an antibody to the protein(s) and/or immunologically reactive fragment(s) thereof in a sample, such as a biological sample from a subject.

Thus, in one embodiment, the present invention provides a method of diagnosing tubal factor infertility in a subject, comprising, consisting essentially of or consisting of: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof, and *Chlamydia trachomatis* CT875 or an immunologically reactive fragment thereof; and (b) detecting formation of an antigen/antibody complex with each of the antigen of *Chlamydia trachomatis* CT443 or an immunologically reactive fragment thereof and the antigen of *Chlamydia trachomatis* CT381 or an immunologically reactive fragment thereof and not detecting formation of an antigen/antibody complex with the antigen of *Chlamydia trachomatis* CT875 or an immunologically reactive fragment thereof in the sample, thereby diagnosing tubal factor infertility in the subject.

When a subject's infertility is diagnosed to be due to tubal factor as a result of chlamydial infection, a treatment option for the woman's infertility can be in vitro fertilization (IVF). Furthermore, applying both anti-chlamydial and anti-inflammatory treatment procedures to the subjects prior to IVF can increase the chance of success for IVF. Thus, in some embodiments, the method above can further comprise the step of advising and/or having the subject that has been diagnosed with tubal factor infertility to initiate IVF procedures to become pregnant. Such methods can further comprise the step of applying anti-chlamydial and/or anti-inflammatory treatment procedures to the subject.

Furthermore, the present invention provides a method of identifying a subject as having an increased likelihood of having or developing tubal factor infertility, comprising, consisting essentially of or consisting of: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or an immunologically reactive fragment thereof and the antigen of *Chlamydia trachomatis* CT381 or an immunologically reactive fragment thereof and not detecting formation of an antigen/antibody complex with the antigen of *Chlamydia trachomatis* CT875 or an immunologically reactive fragment thereof in the sample, thereby identifying the subject as having an increased likelihood of having or developing tubal factor infertility.

When a subject is identified as having an increased likelihood of having or developing tubal factor infertility as a result of chlamydial infection, the subject can undergo an infertility evaluation and both anti-chlamydial and anti-inflammatory treatment procedures can be applied to subject if the subject desires to have children. Thus, in some embodiments, the method above can further comprise the step of advising and/or having the subject that has been identified as having an increased likelihood of having or developing tubal factor infertility as a result of chlamydial infection to undergo an infertility evaluation. Such methods can further comprise the step of applying anti-chlamydial and/or anti-inflammatory treatment procedures to the subject.

Establishing that the cause of a woman's infertility is tubal factor infertility according to the methods described herein allows the woman and her physician to avoid approaches that are likely to be unsuccessful, such as hormone replacement and artificial insemination in order to overcome or bypass the woman's infertility and to select more effective methods of establishing a successful pregnancy in the woman, such as in vitro fertilization. The knowledge that the cause of a woman's infertility is tubal factor infertility also informs the woman and her physician that the use of invasive and costly procedures such as hysterosalpingogram (HSG) or laparoscopy may be unnecessary.

Thus, in one embodiment, the present invention also provides a method of identifying a subject as a good or suitable candidate for in vitro fertilization or surgical repair of tubal damage, comprising, consisting essentially of or consisting of: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or an immunologically reactive fragment thereof and the antigen of *Chlamydia trachomatis* CT381 or an immunologically reactive fragment thereof and not detecting formation of an antigen/antibody complex with the antigen of *Chlamydia trachomatis* CT875 or an immunologically reactive fragment thereof in the sample, thereby identifying the subject as a good or suitable candidate for in vitro fertilization or surgical repair of tubal damage. Thus, in some embodiments, the method above can further comprise the step of advising and/or having the subject that has been identified as a good or suitable candidate for in vitro fertilization (IVF) or surgical repair of tubal damage to undergo such IVF or surgery. Such methods can further comprise the step of applying anti-chlamydial and/or anti-inflammatory treatment procedures to the subject.

In some embodiments, the subject of this invention can be a human female and in some embodiments, the subject of this invention can be an infertile human female. In some embodiments, the tubal factor infertility can be caused by chlamydial infection and in some embodiments, the tubal factor infertility can be caused by infection by *Chlamydia trachomatis*.

In certain embodiments of the methods described above regarding tubal factor infertility, the diagnostic panel can further comprise, consist essentially of or consist of an additional antigen selected from the group consisting of a) *Chlamydia trachomatis* HSP60 or an immunologically reactive fragment thereof, b) *Chlamydia trachomatis* CT376 or an immunologically reactive fragment thereof, c) *Chlamydia trachomatis* CT557 or an immunologically reactive fragment thereof, and d) any combination thereof, and the method can further comprise, consist essentially of or consist of detecting an antigen/antibody complex in the sample for each of said additional antigen(s).

In further embodiments, the present invention provides a method of diagnosing acute *Chlamydia trachomatis* infection in a subject, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby diagnosing acute *Chlamydia trachomatis* infection in the subject. The method above can further comprise the step of applying anti-chlamydial and/or anti-inflammatory treatment procedures to the subject.

Also provided herein is a method of diagnosing acute *Chlamydia trachomatis* infection in a subject, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby diagnosing acute *Chlamydia trachomatis* infection in the subject. The method above can further comprise the step of applying anti-chlamydial and/or anti-inflammatory treatment procedures to the subject.

The present invention also provides a method of identifying a subject as having an increased likelihood of having an acute *Chlamydia trachomatis* infection, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby identifying the subject as having an increased likelihood of having an acute *Chlamydia trachomatis* infection. The method above can further comprise the step of applying anti-chlamydial and/or anti-inflammatory treatment procedures to the subject.

Additionally provided herein is a method of identifying a subject as having an increased likelihood of having an acute *Chlamydia trachomatis* infection, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby identifying the subject as having an increased likelihood of having an acute *Chlamydia trachomatis* infection. The method above can further comprise the step of applying anti-chlamydial and/or anti-inflammatory treatment procedures to the subject.

Additionally provided herein is a method of identifying a subject for whom antibiotic therapy for *Chlamydia trachomatis* infection is likely to be or would be beneficial, comprising: (a) contacting a biological sample from the subject with a diagnostic panel comprising an antigen of each of *Chlamydia trachomatis* CT443 or an immunologically reactive fragment thereof, *Chlamydia trachomatis* CT381 or an immunologically reactive fragment thereof and *Chlamydia trachomatis* CT875 or an immunologically reactive fragment thereof; and (b) detecting formation of an antigen/antibody complex with each of the antigen of *Chlamydia trachomatis* CT443 or immunologically reactive fragment thereof, the antigen of *Chlamydia trachomatis* CT381 or immunologically reactive fragment thereof and the antigen of *Chlamydia trachomatis* CT875 or the immunologically reactive fragment in the sample, thereby identifying a subject for whom antibiotic therapy to treat *Chlamydia trachomatis* infection is likely to be or would be beneficial. The method above can further comprise the step of applying antibiotic therapy for *Chlamydia trachomatis* infection and/or anti-inflammatory treatment procedures to the subject.

Also provided herein is a method of identifying a subject for whom antibiotic therapy for *Chlamydia trachomatis* infection is likely to be or would be beneficial, comprising: (a) contacting a biological sample from the subject with an antigen of *Chlamydia trachomatis* CT875 or immunologically reactive fragment thereof; and (b) detecting formation of an antigen/antibody complex with the antigen of *Chlamydia trachomatis* CT875 or immunologically reactive fragment thereof in the sample, thereby identifying a subject for whom antibiotic therapy for *Chlamydia trachomatis* infection is likely to be or would be beneficial. The method above can further comprise the step of applying antibiotic therapy for *Chlamydia trachomatis* infection and/or anti-inflammatory treatment procedures to the subject.

In some embodiments the method of diagnosing acute chlamydial infection or identifying a subject as having an increased likelihood of having an acute *Chlamydia trachomatis* infection or identifying a subject for whom antibiotic therapy for *Chlamydia trachomatis* infection can further comprise, consist essentially of or consist of contacting the sample with an antigen of *Chlamydia trachomatis* CT147 or immunologically reactive fragment thereof and detecting an antigen/antibody complex in the sample with the antigen of *Chlamydia trachomatis* CT147 or immunologically reactive fragment thereof.

A biological sample of this invention can be any biological fluid and/or tissue in which antibodies can be detected. Non-limiting examples of a sample of this invention can include vaginal fluid, vaginal tissue, vaginal washing, vaginal swab, vaginal discharge, cervical swab, cervical tissue urethral swab, urethral discharge, rectal swab, rectal material, rectal washing, urine, blood, serum, plasma, saliva, tears, skin swab, semen, seminal fluid, sputum, bronchial fluid, bronchial washing, peritoneal fluid, peritoneal washing, pleural fluid, pleural washing, cerebrospinal fluid, eye fluid and/or tissue, fluid and/or tissue from lung, liver, heart, brain, kidney, spleen or muscle and any combination thereof.

In some embodiments, the biological sample of this invention to be used in the methods of this invention can be diluted 1:10, 1:100, 1:200, 1:300, 1:400, 1:500, 1:600, 1:700, 1:800, 1:900, 1:1000, 1:1500, 1:2000, 1:3000, 1:4000, 1:5000, 1:6000, 1:7000, 1:8000, 1:9000, 1:10,000, 1:20,000, 1:30,000, 1:40,000, 1:50,000, 1:100,000, etc. Such a dilution can be carried out according to protocols well known in the art and as described in the EXAMPLES section herein. Such dilution can be used to increase the specificity of the method, as described herein.

In the methods of this invention, the biological sample can be preabsorbed, e.g., to reduce or minimize cross-reactivity and/or background. As nonlimiting examples, in some embodiments, the biological sample can be preabsorbed with a lysate of bacteria expressing glutathione-S-transferase (GST) and/or a lysate of normal (e.g., non-chlamydial infected mammalian cells. In some embodiments absorption of the sample can be with a lysate of *Chlamydia*-infected mammalian cells, to remove and/or block chlamydial antigen-specific antibodies from human samples, which can help confirm the specificity of human antibody binding to the test antigen.

A subject of this invention that has an "increased likelihood" or "increased risk" of having or tubal factor infertility can be a subject having symptoms and/or signs of infertility and/or meets criteria known in the art for being infertile or such a subject can be a subject who is not having symptoms and/or signs of infertility and/or does not meet criteria know in the art for being infertile. By "increased likelihood" or "increased risk" of having tubal factor infertility it is meant that the increase is relative to a control (e.g., a subject whose biological sample is not positive for antibodies to CT443 and CT381 and negative for antibodies to CT875).

Furthermore, a subject of this invention that has an "increased likelihood" or "increased risk" of having an acute *Chlamydia trachomatis* infection can be a subject having symptoms and/or signs of *Chlamydia trachomatis* infection or such a subject can be a subject who is not having symptoms and/or signs of *Chlamydia trachomatis* infection. By "increased likelihood" or "increased risk" of acute *Chlamydia trachomatis* infection it is meant that the increase is relative to a control (e.g., a subject whose biological sample is not positive for antibodies to CT443 and CT381 and CT875 or a subject whose biological sample is not positive for antibodies to CT875).

In additional embodiments of this invention, the chlamydial proteins listed herein can also be employed in the methods and compositions of this invention, either singly or in any combination with one another and/or in combination with any other chlamydial protein and/or reagent of this invention.

As used herein, "a," "an" or "the" can mean one or more than one. For example, "a" cell can mean a single cell or a multiplicity of cells.

Also as used herein, "and/or" refers to and encompasses any and all possible combinations of one or more of the associated listed items, as well as the lack of combinations when interpreted in the alternative ("or").

Furthermore, the term "about," as used herein when referring to a measurable value such as an amount of a compound or agent of this invention, dose, time, temperature, and the like, is meant to encompass variations of ±20%, ±10%, ±5%, ±1%, ±0.5%, or even ±0.1% of the specified amount.

The term "isolated" as used herein means the protein or polypeptide or immunologically reactive fragment or nucleic acid of this invention is sufficiently free of contaminants or cell components with which polypeptides and/or nucleic acids normally occur. "Isolated" does not mean that the preparation is technically pure (homogeneous), but it is sufficiently pure to provide the polypeptide or nucleic acid in a form in which it can be used in methods of this invention.

The term "epitope" as used herein refers to at least about 3 to about 5, or about 5 to about 10 or about 5 to about 15, and not more than about 1,000 amino acids (or any integer therebetween) (e.g., 5-12 amino acids or 3-10 amino acids or 4-8 amino acids or 6-15 amino acids, etc.), which define a sequence that by itself or as part of a larger sequence, binds to an antibody generated in response to such sequence or stimulates a cellular immune response. There is no critical upper limit to the length of the fragment, which can comprise nearly the full-length of the protein sequence, or even a fusion protein comprising two or more epitopes from a single or multiple chlamydial proteins. An epitope for use in the subject invention is not limited to a polypeptide having the exact sequence of the portion of the parent protein from which it is derived. Indeed, there are many known strains or isolates of *Chlamydia* and there are several variable domains that exhibit relatively high degrees of variability between isolates. Thus, the term "epitope" encompasses sequences identical to the native sequence, as well as modifications to the native sequence, such as deletions, additions and substitutions (generally, but not always, conservative in nature). In some embodiments, an "immunologically reactive fragment" of this invention can comprise one, two, three, four or more epitopes of a protein of this invention.

Regions of a given polypeptide or fragment thereof that include an epitope can be identified using any number of epitope mapping techniques, well known in the art. (See, e.g., *Epitope Mapping Protocols in Methods in Molecular Biology*, Vol. 66, Glenn E. Morris, Ed., 1996, Humana Press, Totowa, N.J.). For example, linear epitopes can be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al. (1984) *Proc. Natl. Acad. Sci.* USA 81:3998-4002; Geysen et al. (1986) *Molec. Immunol.* 23:709-715, all incorporated herein by reference in their entireties.

Similarly, conformational epitopes are readily identified by determining spatial conformation of amino acids such as by, e.g., x-ray crystallography and 2-dimensional nuclear magnetic resonance. Antigenic regions of proteins can also be identified using standard antigenicity and hydropathy plots, such as those calculated using, e.g., the Omiga version 1.0 software program available from the Oxford Molecular Group. This computer program employs the Hopp/Woods method (Hopp et al., *Proc. Natl. Acad. Sci* USA (1981) 78:3824-3828) for determining antigenicity profiles and the Kyte-Doolittle technique (Kyte et al., *J. Mol. Biol.* (1982) 157:105-132) for hydropathy plots.

As used herein, the term "polypeptide" or "protein" is used to describe a chain of amino acids that correspond to those encoded by a nucleic acid. A polypeptide or protein of this invention can be a peptide, which usually describes a chain of amino acids of from two to about 30 to about 50 amino acids. The term polypeptide as used herein also describes a chain of amino acids having more than about 30 amino acids or more than about 50 amino acids and can be a fragment or domain of a protein or a full length protein. Furthermore, as used herein, the term polypeptide can refer to a linear chain of amino acids or it can refer to a chain of amino acids that has been processed and folded into a functional protein. It is understood, however, that 30 or 50 is an arbitrary number with regard to distinguishing peptides and polypeptides and the terms can be used interchangeably for a chain of amino acids. The polypeptides of the present invention are obtained by isolation and purification of the polypeptides from cells where they are produced naturally, by enzymatic (e.g., proteolytic) cleavage, and/or recombinantly by expression of nucleic acid encoding the polypeptides or fragments of this invention. The polypeptides and/or fragments of this invention can also be obtained by chemical synthesis or other known protocols for producing polypeptides and fragments.

The amino acid sequences of this invention are presented in the amino to carboxy direction, from left to right. The "carboxy terminus" or "C terminus" of a protein or amino acid sequence as used herein refers to a portion or fragment or domain of a protein or amino acid sequence that makes up about ⅔, about ½, about ⅓ or about ¼ of the total amino acid sequence at the carboxy end of the sequence (i.e., the right end or right-sided end or the "end" of the sequence). The "amino terminus" or "N terminus" of a protein or amino acid sequence as used herein refers to a portion or fragment or domain of a protein or amino acid sequence that makes up about ⅔, about ½, about ⅓ or about ¼ of the total amino acid sequence at the amino end of the sequence (i.e., the left end or left sided end or the "beginning" of the sequence).

Nucleotide sequences are presented herein by single strand only, in the 5' to 3' direction, from left to right. However, it is intended that the nucleic acids of this invention can be either single or double stranded (i.e., including the complementary nucleic acid). A nucleic acid of this invention can be the complement of a nucleic acid described herein.

A "biologically active fragment" includes a polypeptide or peptide of this invention that comprises a sufficient number of amino acids to have one or more of the biological activities of the polypeptides of this invention. Such biological activities can include, but are not limited to, in any combination, binding activity and/or immunogenic activity, as well as any other activity now known or later identified for the polypeptides and/or fragments of this invention.

An "immunologically reactive fragment," "immunogenic fragment" or "antigenic fragment" of a protein refers to a portion of the protein or peptide that is immunologically reactive with a binding partner, e.g., an antibody, which is immunologically reactive with the protein or peptide itself.

In some embodiments, the terms "immunologically reactive fragment," "immunogenic fragment" or "antigenic fragment" are used to describe a fragment or portion of a protein or peptide that can stimulate a humoral and/or cellular immune response in a subject. An immunologically reactive fragment, immunogenic fragment or antigenic fragment of this invention can comprise, consist essentially of and/or consist of one, two, three, four or more epitopes of a protein of this invention. An immunologically reactive fragment, immunogenic fragment or antigenic fragment can be any fragment of contiguous amino acids of a *Chlamydia trachomatis* protein of this invention, including but not limited to CT443, CT381, CT875, CT147, HSP60, CT376, CT557, CT858 (CPAF), Pgp3, CT823 (cHtrA), CT681 (MOMP), CT119 (IncA), CT813, CT795, CT621 and CT622, the amino acid sequences of each of which are provided herein and are available at www.ncbi.nlm.nih.gov/protein/15605169) and can be for example, 5, 10, 15, 20, 25, 30, 35, 40, 45, 50, 75, 100, 150, 200, 250, 300, 350, 400, 450, 500, 550, 600, 650, 700, 750, 800, 850, 900, 950 or 1000 amino acids in length, dependent upon the total number of amino acids of the full length protein. Identification of any such immunologically reactive, immunogenic or antigenic fragment(s) is routine in the art.

Nonlimiting examples of an immunologically reactive fragment of *Chlamydia trachomatis* CT443 protein (GenBank Database® Accession No. NP_219955.1) include amino acids 41-269 (F1), amino acids 166-269 (F2), amino acids 211-269 (F3), amino acids 101-210 (F4), amino acids 166-210 (F5), amino acids 41-165 (F6), amino acids 101-165 (F7), amino acids 41-100 (F8), amino acids 211-410 (F9), amino acids 270-410 (F10), amino acids 270-553 (F11) and amino acids 411-553 (F12), with amino acid numbering starting with amino acid 1 and ending with amino acid 553 of the 553 amino acid CT443 protein, the amino acid sequence of which is provided herein. As described herein, in some embodiments, fragments identified above as F1 through F8 could be described as N terminal or amino terminal fragments. As also described herein, in some embodiments, fragments identified above as F9 through F12 could be described as C terminal or carboxy terminal fragments. In some embodiments of this invention, the CT443 protein or immunologically reactive fragment employed in methods of this invention can be a C terminal fragment.

Nonlimiting examples of an immunologically reactive fragment of *Chlamydia trachomatis* CPAF protein (GenBank Database® Accession No. AAC68456.1) include amino acids 1-200, amino acids 136-609, amino acids 242-609, amino acids 284-609 and amino acids 387-609 with numbering starting from amino acid 1 at the amino terminus through amino acid 609 at the carboxy terminus of the 609 amino acid CPAF protein, the amino acid sequence of which is provided herein and is available under GenBank Database® Accession No. AAC68456.1.

Also provided herein is an isolated peptide comprising, consisting essentially of or consisting of about five amino acids to about 15, 20, 25, 30, 35, 40, 45, 50, 50, 70, 80, 90 or 100 amino acids (including any value between 5 and 100 not explicitly recited herein), wherein the peptide comprises one or more (e.g., 2, 3, 4, 5, 6, 7, 8, 9, 10, 11, 12, 13, 14, 15, 16, 17, 18, 19 or 20) of the 5 mer peptides listed in Table 6, as well as a composition comprising any of these isolated peptides, singly or in any combination in a carrier (e.g., a pharmaceutically acceptable carrier). Such peptides can be employed as immunologically reactive fragments in the methods of this invention.

It is further provided herein that in the methods of this invention, an immunologically reactive fragment of this invention and a biological sample diluted as described herein can be employed in any combination in the methods described herein to increase the specificity of the method. As one nonlimiting example, a biological sample diluted 1:3000 was reacted with the F11 fragment of chlamydial protein CT443 resulting in an increase in specificity of the assay and further diluting the sample 1:10,000 increased specificity even more (see Example 2). Optimization of the sample dilution and immunologically reactive fragment reactivity can be carried out as described herein and according to methods well known in the art.

A fragment of a polypeptide or protein of this invention can be produced by methods well known and routine in the art. Fragments of this invention can be produced, for example, by enzymatic or other cleavage of naturally occurring peptides or polypeptides or by synthetic protocols that are well known.

Such fragments can be tested for one or more of the biological activities of this invention according to the methods described herein, which are routine methods for testing activities of polypeptides, and/or according to any art-known and routine methods for identifying such activities. Such production and testing to identify biologically active fragments and/or immunologically reactive fragments of the polypeptides described herein would be well within the scope of one of ordinary skill in the art and would be routine.

As used herein, the term "antibody" includes intact immunoglobin molecules as well as fragments thereof, such as Fab, F(ab')2, and Fc, which are capable of binding the epitopic determinant of an antigen (i.e., antigenic determinant). Antibodies that bind the polypeptides of this invention are prepared using intact polypeptides or fragments containing small peptides of interest as the immunizing antigen. The polypeptide or fragment used to immunize an animal can be derived from enzymatic cleavage, recombinant expression, isolation from biological materials, synthesis, etc., and can be conjugated to a carrier protein, if desired. Commonly used carriers that are chemically coupled to peptides and proteins for the production of antibody include, but are not limited to, bovine serum albumin, thyroglobulin and keyhole limpet hemocyanin. The coupled peptide or protein is then used to immunize the animal (e.g., a mouse, rat, or rabbit). The polypeptide or peptide antigens can also be administered with an adjuvant, as described herein and as otherwise known in the art. The term "antibody" as used herein, includes, but is not limited to a polypeptide encoded by an immunoglobulin gene or immunoglobulin genes, or a fragment thereof. "Antibody" also includes, but is not limited to, a polypeptide encoded by an immunoglobulin gene or immunoglobulin genes, or a fragment thereof, which specifically binds to and recognizes the biomarkers of this invention.

The term "epitope" means an antigenic determinant that is specifically bound by an antibody. Epitopes usually consist of surface groupings of molecules such as amino acids and/or sugar side chains and usually have specific three-dimensional structural characteristics, as well as specific charge characteristics.

The terms "specifically binds to" and "specifically reactive with" refer to a binding reaction that is determinative of the presence of the antigen and antibody or aptamer and target in the presence of a heterogeneous population of proteins, nucleic acids and/or other biologics. Thus, under designated assay conditions, the specified antibodies and antigens and/or aptamers and targets bind to one another and do not bind in a significant amount to other components present in a sample.

In some embodiments employing antibodies, a variety of immunoassay formats can be used to select antibodies specifically reactive with a particular antigen. For example, solid-phase ELISA immunoassays are routinely used to select monoclonal antibodies specifically immunoreactive with an analyte. See Harlow and Lane (ANTIBODIES: A LABORATORY MANUAL, Cold Springs Harbor Publications, New York, (1988)) for a description of immunoassay formats and conditions that can be used to determine specific immunoreactivity. Typically a specific or selective reaction will be at least twice background signal to noise and more typically more than 10 to 100 times greater than background.

Various immunoassays can be used to detect antibodies of this invention. Such immunoassays typically involve the measurement of antigen/antibody complex formation between a protein or peptide and its specific antibody.

The immunoassays of the invention can be either competitive or noncompetitive and both types of assays are well-known and well-developed in the art. In competitive binding assays, antigen or antibody competes with a detectably labeled antigen or antibody for specific binding to a capture site bound to a solid surface. The concentration of labeled antigen or antibody bound to the capture agent is inversely proportional to the amount of free antigen or antibody present in the sample.

Noncompetitive assays of this invention can be sandwich assays, in which, for example, the antigen is bound between two antibodies. One of the antibodies is used as a capture agent and is bound to a solid surface. The other antibody is labeled and is used to measure or detect the resultant antigen/antibody complex by e.g., visual or instrument means. A number of combinations of antibody and labeled antibody can be used, as are well known in the art. In some embodiments, the antigen/antibody complex can be detected by other proteins capable of specifically binding human immunoglobulin constant regions, such as protein A, protein L or protein G. These proteins are normal constituents of the cell walls of streptococcal bacteria. They exhibit a strong nonimmunogenic reactivity with immunoglobulin constant regions from a variety of species. (See, e.g., Kronval et al., *J. Immunol.*, 111:1401-1406 (1973); Akerstrom et al., *J. Immunol.*, 135: 2589-2542 (1985).)

In some embodiments, the non-competitive assays need not be sandwich assays. For instance, the antibodies or antigens in the sample can be bound directly to the solid surface. The presence of antibodies or antigens in the sample can then be detected using labeled antigen or antibody, respectively.

In some embodiments, antibodies and/or proteins can be conjugated or otherwise linked or connected (e.g., covalently or noncovalently) to a solid support (e.g., bead, plate, slide, dish, membrane or well) in accordance with known techniques. Antibodies can also be conjugated or otherwise linked or connected to detectable groups such as radiolabels (e.g., $^{35}S$, $^{125}I$, $^{32}P$, $^{13}H$, $^{14}C$, $^{131}I$), enzyme labels (e.g., horseradish peroxidase, alkaline phosphatase), gold beads, chemiluminescence labels, ligands (e.g., biotin) and/or fluorescence labels (e.g., fluorescein) in accordance with known techniques.

A variety of organic and inorganic polymers, both natural and synthetic can be used as the material for the solid surface. Nonlimiting examples of polymers include polyethylene, polypropylene, poly(4-methylbutene), polystyrene, polymethacrylate, poly(ethylene terephthalate), rayon, nylon, poly(vinyl butyrate), polyvinylidene difluoride (PVDF), silicones, polyformaldehyde, cellulose, cellulose acetate, nitrocellulose, and the like. Other materials that can be used include, but are not limited to, include paper, glass, ceramic, metal, metalloids, semiconductive materials, cements and the like. In addition, substances that form gels, such as proteins (e.g., gelatins), lipopolysaccharides, silicates, agarose and polyacrylamides can be used. Polymers that form several aqueous phases, such as dextrans, polyalkylene glycols or surfactants, such as phospholipids, long chain (12-24 carbon atoms) alkyl ammonium salts and the like are also suitable. Where the solid surface is porous, various pore sizes can be employed depending upon the nature of the system.

A variety of immunoassay systems can be used, including but not limited to, radio-immunoassays (RIA), enzyme-linked immunosorbent assays (ELISA) assays, enzyme immunoassays (EIA), "sandwich" assays, gel diffusion precipitation reactions, immunodiffusion assays, agglutination assays, immunofluorescence assays, fluorescence activated cell sorting (FACS) assays, immunohistochemical assays, protein A immunoassays, protein G immunoassays, protein L immunoassays, biotin/avidin assays, biotin/streptavidin assays, immunoelectrophoresis assays, precipitation/flocculation reactions, immunoblots (Western blot; dot/slot blot); immunodiffusion assays; liposome immunoassay, chemiluminescence assays, library screens, expression arrays, etc., immunoprecipitation, competitive binding assays and immunohistochemical staining. These and other assays are described, among other places, in Hampton et al. (*Serological Methods, a Laboratory Manual*, APS Press, St Paul, Minn. (1990)) and Maddox et al. (*J. Exp. Med.* 158:1211-1216 (1993); the entire contents of which are incorporated herein by reference for teachings directed to immunoassays).

The methods of this invention can also be carried out using a variety of solid phase systems, such as described in U.S. Pat. No. 5,879,881, as well as in a dry strip lateral flow system (e.g., a "dipstick" system), such as described, for example, in U.S. Patent Publication No. 20030073147, the entire contents of each of which are incorporated by reference herein.

The term "antibody" or "antibodies" as used herein refers to all types of immunoglobulins, including IgG, IgM, IgA, IgD, and IgE. The antibody can be monoclonal or polyclonal and can be of any species of origin, including, for example, mouse, rat, rabbit, horse, goat, sheep or human, or can be a chimeric or humanized antibody. See, e.g., Walker et al., *Molec. Immunol.* 26:403-11 (1989). The antibodies can be recombinant monoclonal antibodies produced according to the methods disclosed in U.S. Pat. No. 4,474,893 or U.S. Pat. No. 4,816,567. The antibodies can also be chemically constructed according to the method disclosed in U.S. Pat. No. 4,676,980. The antibody can further be a single chain antibody or bispecific antibody.

Antibody fragments included within the scope of the present invention include, for example, Fab, F(ab')2, and Fc fragments, and the corresponding fragments obtained from antibodies other than IgG. Such fragments can be produced by known techniques. For example, F(ab')2 fragments can be produced by pepsin digestion of the antibody molecule, and Fab fragments can be generated by reducing the disulfide bridges of the F(ab')2 fragments. Alternatively, Fab expression libraries can be constructed to allow rapid and easy identification of monoclonal Fab fragments with the desired specificity (Huse et al., (1989) *Science* 254:1275-1281).

Monoclonal antibodies can be produced in a hybridoma cell line according to the technique of Kohler and Milstein, (1975) *Nature* 265:495-97. For example, a solution containing the appropriate antigen can be injected into a mouse and, after a sufficient time, the mouse sacrificed and spleen cells obtained. The spleen cells are then immortalized by fusing them with myeloma cells or with lymphoma cells, typically in the presence of polyethylene glycol, to produce hybridoma cells. The hybridoma cells are then grown in a suitable medium and the supernatant screened for monoclonal antibodies having the desired specificity. Monoclonal Fab fragments can be produced in bacterial cell such as *E. coli* by recombinant techniques known to those skilled in the art. See, e.g., W. Huse, (1989) *Science* 246:1275-81.

Antibodies can also be obtained by phage display techniques known in the art or by immunizing a heterologous host with a cell containing an epitope of interest.

The term "sample" as used herein is used in its broadest sense. A biological sample suspected of containing a polypeptide, fragment, antibody and/or nucleic acid of this invention can be any biological fluid, an extract from a cell, an extracellular matrix isolated from a cell, a cell (in solution or bound to a solid support), a tissue, a tissue print, and the like.

A "pharmaceutically acceptable" component such as a salt, carrier, excipient or diluent of a composition according to the present invention is a component that (i) is compatible with the other ingredients of the composition in that it can be combined with the compositions of the present invention without rendering the composition unsuitable for its intended purpose, and (ii) is suitable for use with subjects as provided herein without undue adverse side effects (such as toxicity, irritation, and allergic response). Side effects are "undue" when their risk outweighs the benefit provided by the composition. Non-limiting examples of pharmaceutically acceptable components include, without limitation, any of the standard pharmaceutical carriers such as phosphate buffered saline solutions, water, emulsions such as oil/water emulsion, microemulsions and various types of wetting agents.

A variety of protocols for detecting the presence of and/or measuring the amount of an antibody or antibodies in a sample are known in the art. Such protocols are well known in the art and non-limiting examples include enzyme immunoassays (ETA), agglutination assays, immunoblots (Western blot; dot/slot blot, etc.), radioimmunoassays (RIA), immunodiffusion assays, chemiluminescence assays, antibody library screens, expression arrays, enzyme-linked immunosorbent assays (ELISA), radioimmunoassays (RIA), immunoprecipitation, Western blotting, competitive binding assays, immunofluorescence, immunohistochemical staining precipitation/flocculation assays and fluorescence-activated cell sorting (FACS). These and other assays are described, among other places, in Hampton et al. (*Serological Methods, a Laboratory Manual*, APS Press, St Paul, Minn. (1990)) and Maddox et al. (*J. Exp. Med.* 158:1211-1216 (1993)).

The present invention further provides isolated polypeptides, peptides, proteins and/or fragments that are substantially equivalent to those described for this invention. As used herein, "substantially equivalent" can refer both to nucleic acid and amino acid sequences, for example a mutant sequence, that varies from a reference sequence by one or more substitutions (e.g., substitution with conservative amino acids as are well known in the art), deletions and/or additions, the net effect of which does not result in an undesirable adverse functional dissimilarity between reference and subject sequences. In some embodiments, this invention can include substantially equivalent sequences that have an adverse functional dissimilarity. For purposes of the present invention, sequences having equivalent biological activity and equivalent expression characteristics are considered substantially equivalent.

The invention further provides homologues, as well as methods of obtaining homologues, of the polypeptides and/or fragments of this invention from other strains of *Chlamydia* and/or other organisms included in this invention. As used herein, an amino acid sequence or protein is defined as a homologue of a polypeptide or fragment of the present invention if it shares significant homology to one of the polypeptides and/or fragments of the present invention. Significant homology means at least 75%, 80%, 85%, 90%, 95%, 98% and/or 100% homology with another amino acid sequence. Specifically, by using the nucleic acids that encode the chlamydial proteins of this invention (as are known in the art and incorporated by reference herein), as a probe or primer, and techniques such as PCR amplification and colony/plaque hybridization, one skilled in the art can identify homologues of the polypeptides and/or fragments of this invention in *Chlamydia* and/or other organisms on the basis of information available in the art. A homologue of a *Chlamydia trachomatis* protein of this invention can include a protein of *Chlamydia muridarum, Chlamydia pneumoniae, Chlamydia psittaci* or *Chlamydia caviae* identified to be a homologue according to methods well known in the art and as described herein. It would be well understood by one of ordinary skill in the art that such homologues (either complete proteins and/or immunologically reactive fragments thereof) can be employed in the methods of this invention. The identification and testing of such homologues for suitability as antigens in the methods of this invention is well within the skill of one in the art. Such homologues among the proteins of *Chlamydia trachomatis, Chlamydia muridarum, Chlamydia pneumoniae, Chlamydia psittaci* and *Chlamydia caviae* are well known in the art. As one non-limiting example, a listing of *Chlamydia pneumoniae* proteins and the *Chlamydia trachomatis* homologues of these proteins can be found in U.S. Pat. No. 6,822,071, the entire contents of which are incorporated by reference herein for these teachings.

In some embodiments, the present invention provides the antigens of this invention immobilized on a solid support (e.g., beads, plates, slides or wells formed from materials such as, e.g., latex or polystyrene). Nonlimiting examples of such solid supports include polycarbonate, agarose, nitrocellulose, sepharose, acrylic resins, polyacrylamide and latex beads, as well as any other solid support known in the art. Techniques for coupling antibodies and antigens to such solid supports are well known in the art (Weir et al., *Handbook of Experimental Immunology* 4th Ed., Blackwell Scientific Publications, Oxford, England, Chapter 10 (1986)). Antibodies and/or antigens of this invention can likewise be conjugated to detectable groups such as radiolabels (e.g., $^{35}S$, $^{125}I$, $^{131}I$), enzyme labels (e.g., horseradish peroxidase, alkaline phosphatase), and fluorescence labels (e.g., fluorescein) in accordance with known techniques. Conditions suitable for the formation of an antigen/antibody complex are routine in the art and form the basis for all immunoassays. Such conditions may vary depending on the particular reagents, samples and/or steps employed in a given immunoassay, as would be readily determined by one of ordinary skill in the art. Determination of the formation of an antibody/antigen complex in the methods of this invention can be by detection of, for example, precipitation, agglutination, flocculation, radioactivity, color development or change, fluorescence, luminescence, etc., as is well know in the art.

It is further contemplated that the present invention provides kits for detection, in a biological sample, of antibodies specifically reactive to antigens of this invention. In one embodiment, the kit can comprise one or more antigens of this invention, along with suitable buffers, wash solutions and/or other reagents for the detection of antibody/antigen complex formation.

In one embodiment, a kit of this invention can comprise, consist essentially of and/or consist of antigens (e.g., a diagnostic panel) and reagents for detecting, in a biological sample, the presence or absence of 1) an antibody that specifically reacts with *Chlamydia trachomatis* CT443 protein or an immunologically reactive fragment thereof, 2) an antibody that specifically reacts with *Chlamydia trachomatis* CT875 protein or an immunologically reactive fragment thereof and 3) *Chlamydia trachomatis* CT381 protein or an immunologically reactive fragment thereof. In some embodiments, the kit described in this paragraph can further comprise, consist essentially of or consist of antigens (e.g., as additional components of a diagnostic panel) and reagents for detecting, in a biological sample, the presence or absence of *Chlamydia trachomatis* HSP60 protein or an immunologically reactive fragment thereof, *Chlamydia trachomatis* CT376 protein or an immunologically reactive fragment thereof, *Chlamydia trachomatis* CT557 protein or an immunologically reactive fragment thereof, and any combination thereof. Thus, a kit of this invention can include a diagnostic panel that comprises, consists essentially of or consists of an antigen of *Chlamydia trachomatis* CT443 protein or an immunologically reactive fragment thereof, an antigen of *Chlamydia trachomatis* CT875 protein or an immunologically reactive fragment thereof, an antigen of *Chlamydia trachomatis* CT381 protein or an immunologically reactive fragment thereof. Such a kit can further include, in its diagnostic panel, an antigen of *Chlamydia trachomatis* HSP60 protein or an immunologically reactive fragment thereof, an antigen of *Chlamydia trachomatis* CT376 protein or an immunologically reactive fragment thereof, an antigen of *Chlamydia trachomatis* CT557 protein or an immunologically reactive fragment thereof, and any combination thereof.

In a further embodiment, a kit of this invention can comprise, consist essentially of and/or consist of antigens (e.g., a diagnostic panel) and reagents for detecting, in a biological sample, the presence or absence of 1) an antibody that specifically reacts with *Chlamydia trachomatis* CT443 protein or an immunologically reactive fragment thereof, 2) an antibody that specifically reacts with *Chlamydia trachomatis* CT875 protein or an immunologically reactive fragment thereof, 3) *Chlamydia trachomatis* CT381 protein or an immunologically reactive fragment thereof and 4) an antigen of *Chlamydia trachomatis* CT147 protein or an immunologically reactive fragment thereof. Thus, a kit of this invention can include a diagnostic panel that comprises, consists essentially of or consists of an antigen of *Chlamydia trachomatis* CT443 protein or an immunologically reactive fragment thereof, an antigen of *Chlamydia trachomatis* CT875 protein or an immunologically reactive fragment thereof, an antigen of *Chlamydia trachomatis* CT381 protein or an immunologically reactive fragment thereof and an antigen of *Chlamydia trachomatis* CT147 protein or an immunologically reactive fragment thereof.

In another embodiment, a kit of this invention comprise, consist essentially of and/or consist of antigens (e.g., a diagnostic panel) and reagents for detecting, in a biological sample, the presence or absence of an antibody that specifically reacts with *Chlamydia trachomatis* CT875 protein or an immunologically reactive fragment thereof. Such a kit can further comprise, consist essentially of or consist of antigens (e.g., as additional components of a diagnostic panel) and reagents for detecting in a biological sample, the presence or absence of an antibody that specifically reacts with *Chlamydia trachomatis* CT147 protein or an immunologically reactive fragment thereof. Thus a kit of this invention can include a diagnostic panel that comprises, consists essentially of or consists of an antigen of *Chlamydia trachomatis* CT875 protein or an immunologically reactive fragment thereof. In some embodiments, such a kit can further comprise, consist essentially of or consist of *Chlamydia trachomatis* CT147 protein or an immunologically reactive fragment thereof.

It would be well understood by one of ordinary skill in the art that the kits of this invention can comprise one or more containers and/or receptacles to hold the reagents (e.g., antibodies, antigens, nucleic acids) of the kit, along with appropriate buffers and/or wash solutions and directions for using the kit, as would be well known in the art.

The following examples are included to demonstrate various embodiments of the invention. It should be appreciated by those of skill in the art that the techniques disclosed in the examples that follow represent techniques discovered by the inventors to function well in the practice of the invention. However, those of skill in the art should, in light of the present disclosure, appreciate that many changes can be made in the specific embodiments that are disclosed and still obtain a like or similar result without departing from the spirit and scope of the invention.

EXAMPLES

Example 1

Genome-Wide Identification of *Chlamydia trachomatis* Antigens Associated with Tubal Factor Infertility Objective.

To identify *C. trachomatis* antigens that can be used to differentially diagnose tubal factor infertility in comparison to previously reported Heat Shock Protein 60 (HSP60).

Design.

In Vitro Study

Patients.

Infertile women with and without tubal pathology diagnosed laparoscopically.

Setting.

Academic medical center.

Main Outcome Measures.

Antibody responses to *C. trachomatis* in infertile women with or without tubal pathologies using a *C. trachomatis* genome-wide proteome array.

Results.

Comparison of the antibody profiles revealed 30 *C. trachomatis* antigens that were preferentially recognized by tubal factor infertility women with a detection sensitivity and specificity of 80.6% and 56.5%, respectively, 10 of which showed 100% specificity. A combination of CT443 and CT381 antigens yielded the highest detection sensitivity (67.7%) while maintaining 100% specificity.

Conclusion.

These findings have demonstrated that antibodies to CT443 and CT381, when used in combination, have higher sensitivity and specificity in predicting tubal factor infertility than other indicators for tubal factor infertility such as HSP60 antibodies (35.5%, 100%) or hysterosalpingogram (65%, 83%). Using a panel of *C. trachomatis* antigens to serologically diagnose tubal factor infertility can save the patients from undertaking expensive and invasive procedures for determining tubal pathology and choosing treatment plans.

Introduction.

Twenty-five to 35% of patients presenting for infertility evaluation have tubal disease (1-4). *Chlamydia trachomatis* is the primary sexually transmitted infection responsible for tubal factor infertility (TFI) (5-7) with *C. trachomatis* antibodies in approximately 70% of patients (8). *C. trachomatis* infected cells produce inflammatory cytokines (9-10) which may contribute to upper genital tract inflammatory damage (11-13). Lunefeld et al. found that among patients undergoing in vitro fertilization, those with *C. trachomatis* antibodies had decreased pregnancy rates (14).

*C. trachomatis* infection is often asymptomatic so patient history cannot dictate the presence of tubal disease (15-16). Elevated titers of anti-*C. trachomatis* antibodies are associated with TFI, but detection of overall antibody levels lacks the sensitivity and specificity required for differential diagnosis (17).

Measuring anti-*C. trachomatis* antibodies at the single antigen level may offer increased sensitivity and specificity for predicting TFI. Elevated anti-chlamydial heat shock protein 60 (HSP60, CT110) antibodies are associated with TFI (18-27). Anti-HSP60 antibodies are associated with decreased pregnancy rates in patients with an ectopic pregnancy history (17). When HSP60 antibodies are in follicular fluid, there are decreased implantation rates (28-29). Some have postulated that chlamydial HSP60 incites a strong inflammatory response that may cross-react with the highly conserved human HSP60 (25, 30-31). HSP60 may induce T-cell responses that contribute to the tubal damage (32-33).

In the present study a *C. trachomatis* whole-genome scale protein array has been developed that can profile antigen specificities of anti-*Chlamydia trachomatis* antibodies (34).

Human Patients.

Thirty one TFI and 23 IFC patients were enrolled at the University of Texas Health Science Center at San Antonio following Institutional Review Board approval. All women were at least 21 years old and underwent diagnostic laparoscopy with chromotubation as part of their infertility evaluation. Diagnosis of tubal infertility was defined as fallopian pathology consistent with hydrosalpinx, fimbrial phimosis, or peri-tubal adhesions. Exclusion criteria included prior tubal ligation, surgical finding of endometriosis, or a history of pelvic infection or inflammation other than pelvic inflammatory disease such as appendicitis. IFC patients had normal pelvic findings and tubal patency at laparoscopy. After the blood draw, serum samples were stored at −20° C. until analyzed.

Cell Culture and Chlamydial Infection.

As previously described, HeLa cells (American Type Culture Collection, Manassas Va. 20108) were cultured in DMEM (GIBCO PRL, Rockville, Md.) with 10% fetal calf serum (FCS; GIBCO BRL) at 37° C. with 5% carbon dioxide ($CO_2$) (34-36). *C. trachomatis* serovar D or *Chlamydia pneumoniae* AR39 organisms were grown, purified and titrated as previously described (36-38). For immunofluorescence assay, chlamydial organisms were used to infect HeLa cells grown on glass coverslips in 24-well plates. The sub-confluent HeLa cells were treated with DMEM containing 304 ml of DEAE-Dextran (Sigma, St. Louis, Mo.) for 10 minutes at 37° C. After removal of DEAE-Dextran solution, chlamydial organisms were added to the wells for 2 hours at 37° C. The infected cells were continuously cultured in DMEM with 10% FCS and 2 µg/ml of cycloheximide (Sigma, St. Louis, Mo.).

Immunofluorescence Assay (IFA).

Anti-chlamydial organism antibodies in human sera were titrated using an Immunofluorescence assay (IFA) as previously described (34, 36, 39, 40). Briefly, HeLa cells grown on coverslips were infected with *C. trachomatis* or *C. pneumoniae* organisms, fixed 48 h post-infection for *C. trachomatis* and 72 h for *C. pneumoniae* with 2% paraformaldehyde, and permeabilized with 2% saponin at room temperature for 1 hour. After blocking, human sera were added to the *Chlamydia*-infected cell samples. The primary Ab binding was visualized with a goat anti-human IgG conjugated with Cy3 (red; Jackson ImmunoResearch Laboratories, West Grove, Pa.), and DNA was labeled with Hoechst dye (blue; Sigma-Aldrich). The highest dilution of a serum that still gave a positive reactivity was defined as the titer of the given serum sample. Serum samples were serially diluted and the appropriate dilutions were repeated multiple times based on the results obtained from prior dilutions in order to obtain a more accurate titer for each serum. Images were acquired with an Olympus AX70 fluorescence microscope equipped with multiple filter sets (Olympus, Melville, N.Y.) as previously described (36, 40).

Chlamydial Fusion Protein-Arrayed Microplate Enzyme-Linked Immunosorbent Assay (ELISA).

Glutathione S-transferase (GST) fusion protein enzyme-linked immunosorbent assay (ELISA) for detecting human antibody recognition of chlamydial proteins was carried out as previously described (36). Bacterial lysates containing individual chlamydial GST fusion proteins were added to 96 well microplates pre-coated with glutathione (Pierce, Rockford, Ill.) at a 1:10 dilution in PBS with a total volume of 200 μl/well. Lysates containing GST alone, as negative, and GST-chlamydial protease-like activity factor (CPAF), as positive controls, were also included on each plate. The plates were incubated overnight at 4° C. to allow GST fusion proteins to bind to the plate-immobilized glutathione then blocked with 2.5% milk in PBS and washing with PBST (PBS with 0.05% Tween 20; Sigma Aldrich).

The human sera were pre-absorbed with bacterial lysates containing GST at 4° C. overnight, then incubated with glutathione beads (bioWorld, Dublin, Ohio) for 1 hour at room temperature to reduce background caused by non-specific human antibodies. The human antibody reactivity was detected with a goat anti-human-IgG, IgA and IgM conjugated with horse-radish peroxidase (HRP; Jackson ImmunoResearch Laboratories) plus the substrate 2,2'-azino-bi(2-ethylbenzothiazoline-6-sulforic acid)diammonium salt (ABTS; Sigma). The optical density (OD) was measured at 405 nm using a microplate reader (Molecular Devices Corporation, Sunnyvale, Calif.). To confirm the antibody binding specificity, all sera were further absorbed with lysates made from either HeLa cells alone or *C. trachomatis* serovar D-infected HeLa cells prior to reacting with the fusion protein-coated plates. The absorption was carried out as follows: HeLa cells with or without chlamydial infection were lysed via sonication at $2 \times 10^7$ cells per ml of PBS containing a cocktail of protease inhibitors. The pre-diluted serum samples were incubated with cell lysates overnight at 4° C. prior to reacting with the plate-immobilized chlamydial fusion proteins. The antibody binding that remained positive after HeLa-alone lysate absorption but significantly reduced by *Chlamydia*-HeLa lysate absorption was considered true positive.

Data Analyses.

Data were analyzed using SPSS v. 15.0 software (IBM, Chicago, Ill.) as previously described (36, 39). Briefly, titer values were log-transformed to produce a normal distribution and analyses were performed on transformed values. Student's t-Test was utilized to assess anti-*C. trachomatis* and anti-*C. pneumoniae* antibodies to evaluate overall mean differences between the 2 groups of patients. Because the a priori hypothesis was that the TFI group would have higher titers than the IFC group, a one-tailed analysis was used for the *C. trachomatis* data, but a two-tailed analysis was performed on the *C. pneumonia* data because there was no a priori hypothesis. Because the antibody titers had large variations within a given group, the serum titers were evaluated by ranges of <1:10 (Negative), 1:10 to 1:10,000 (Low), and >1:10,000 (High). Chi-Squared and Fisher's Exact Test were employed to compare overall antibodies to *C. trachomatis* and antibodies to *C. pneumoniae*.

ELISA results were analyzed using Student's t-Test and Fisher's Exact Test as appropriate. For the genome-wide ELISA, both Student's t-Test (for comparing quantitative OD value data) and Fisher's Exact Test (for comparing the number of sera positively reacted with a given antigen) were preformed. Using both methods allows for the identification of *C. trachomatis* antigens that are both clinically and statistically significant. When Student's t-Test was utilized, the OD values after subtracting background from the same plate were used. When Fisher's Exact Test was utilized, a response was determined positive when the OD value was equal to or greater than 2 standard deviations above the mean calculated from the same 96 well plate as described previously (39, 41).

Infertile Women with Laparoscopy-Identified Tubal Pathologies Developed Significantly Higher Titers of Anti-*C. trachomatis* Antibodies.

Sera from TFI or IFC were titrated using HeLa cells infected with either *C. trachomatis* or *C. pneumoniae* organisms as antigens in an IFA. TFI Patients developed high titers of antibodies to *C. trachomatis* (p<0.001) but not C, *pneumoniae* (p=0.269) (Table 1). When the patients were categorized based on levels of anti-chlamydial antibodies, most TFI patients developed high titers of anti-*C. trachomatis* antibodies (61.3%) while most IFC patients displayed lower titers (82.6%; p<0.001).

Table 1 shows titers of human antibodies against *C. trachomatis* and *C. pneumoniae*. Serum samples from women with TFI and IFC were 2 fold serially diluted starting with 1:10 and reacted with HeLa cells infected with either *C. trachomatis* or *C. pneumoniae*. The antibody reactivity was detected using an immunofluorescence assay as described herein. The highest dilution that still gave a positive reactivity was defined as the serum titer. Each serum sample was titrated in triplicate and the average was used as the geometric titer of a given serum sample. Student's t-Test was used to quantitatively analyze the differences between the two groups of patients. There is a statistically significant difference in titers of antibodies against *C. trachomatis* (p<0.001) but not *C. pneumoniae* (p=0.269) organisms. When the serum samples were divided into 3 categories (negative, low and high) based on antibody titers, the qualitative analysis with Chi-squared test still revealed a significant difference in the number of sera in different categories between the two groups of patients for antibodies against *C. trachomatis* (p<0.001) but not *C. pneumoniae* (p=0.634) organisms. Further pairwise Chi-squared analyses of the anti-*C. trachomatis* antibodies revealed significant differences between the high vs. low and high vs. negative groups. The number of individuals with high titers of anti-*C. trachomatis* antibodies in the TFI group is significantly higher than that in the IFC group.

Table 2 shows reactivity of 30 *C. trachomatis* antigens with 54 patient sera at 1:800 dilution. The 30 *C. trachomatis* antigens significantly recognized by 24 TFI patients were reacted with 54 patient sera (33 TFI and 21 IFC). All sera were diluted at 1:800 regardless of their overall anti-C, trachomatis antibody titers as determined with the immunofluorescence assay. The mean ODs of each antigen were compared between TFI and IFC groups using Student t-Test and the corresponding p values confirmed that all 30 antigens were significantly recognized by TFI patients. The number of positive recognition by either TFI or IFC was used to calculate recognition specificity and sensitivity as well as positive or negative predicting values (PPV or NPV; right panel). HSP60 (CT110) displayed a detection specificity of 82.6% and sensitivity of 71% and many other immunodominant antigens such as pCTO3 (Pgp3, a plasmid-encoded secreted protein), CT858 (CPAF, a chlamydial protease/proteasome-like activity factor that is secreted into host cell cytosol), CT823 (cHtrA, a secreted stress response serine protease), CT813 (an inclusion membrane protein), CT443 (OmcB, outer membrane complex protein B) and CT143 (a hypothetical protein) behaved similarly. Only the hypothetical protein CT557 had 100% specificity but its sensitivity was only 29%. Thus, under this assay condition, no single antigen or combinations of antigens can achieve 100% specificity with a sensitivity of >50%.

Identification of *C. trachomatis* Antigens Preferentially Recognized by Infertile Women with or without Tubal Pathology.

It is difficult to use the quantitative difference in overall anti-*C. trachomatis* antibodies to diagnose TFI. To identify antigens that are recognized by TFI patients, anti-*C. trachomatis* antibodies in 24 TFI and 11 IFC patients were mapped at the genome-wide scale since these patients displayed an overall anti-*C. trachomatis* antibody titer above 1:1000. These 35 sera recognized *C. trachomatis* antigens distributed across the genome with 265 antigens recognized by at least one antiserum and 643 antigens not detected by any sera. Many *C. trachomatis* antigens are recognized by both groups of patients, but there are antigens preferentially recognized by either group. Thirty antigens were significantly recognized by TFI based on either mean OD values (Student's t-test) or recognition frequency (Fisher's exact test). Reactivity was confirmed using absorption against either HeLa alone or *C. trachomatis*-infected HeLa lysates as described previously (36).

Identification of *C. trachomatis* Antigens Uniquely Recognized by TFI Patients.

To identify antigens that can be used to predict TFI in infertility clinics, antigens were identified that were uniquely recognized by TFI patients. The 30 antigens preferentially recognized by TFI patients (Table 2) were reacted with sera from all 54 patients (including 31 TFI and 23 IFC) regardless of their overall anti-*C. trachomatis* antibody titers. The HSP60 (CT110) reacted with 22 of the 31 TFI and 4 of the 23 IFC sera with a specificity and sensitivity of 82.6% and 71.0%, respectively, in predicting TFI.

To further increase specificity, a 5-fold dilution (final dilution of 1:4000) was used to reduce the false-positive rate. At this dilution, 10 of the 30 antigens, including CT110, CT322, CT376, CT381, CT414, CT443, CT681, CT795, CT798 and CT813, failed to react with any sera from the IFC group. Thus, these 10 antigens were uniquely recognized by TFI patients with a detection specificity of 100%. Dilution of the samples decreased detection sensitivity. HSP60 (CT110) only reacted with 11 out of 31 TFI sera, dropping the detection sensitivity to 35.5% along with three immunodominant antigens (CT795, CT798, CT813). CT443 reacted with 18 of the 31 TFI sera, maintaining a sensitivity of 58.1%. When the reactivity of the 10 antigens was analyzed at each individual antiserum level, it was found that the 10 antigens all together reacted with 21 independent sera of 31 total TFI sera, with a sensitivity of 67.7%. More importantly, this sensitivity can be maintained using fewer antigens. Combining HSP60 with CT376, CT381 and CT798 (total 4 antigens) or CT443 with CT381 (only 2 antigens) maintains sensitivity of 67.7%. As for other immunodominant antigens with a detection specificity of <100%, their detection sensitivity can be 80% even after serum dilution. Due to their ability to generate false positive results by reacting with IFC samples, it is clinically undesirable to use these antigens for screening for TFI.

*C. trachomatis* organisms cause pathologies in the fallopian tubes, leading to complications such as ectopic pregnancy and infertility. Since infertility can be caused by many different factors, distinguishing tubal infertility from other causes is useful for guiding treatment plans. The goal of the current study is to identify *C. trachomatis* antigens that can improve specificity and sensitivity in detecting TFI.

The finding that anti-*C. trachomatis* but not anti-*C. pneumoniae* antibodies are highly associated with TFI is consistent with the literature (42-44). Efforts have been made to develop individual *C. trachomatis* antigen-based detection methods. Previous reports demonstrate that anti-HSP60 antibodies are detected in 70-80% of TFI patients (21-22, 45-46). The present genome-wide search for additional markers of TFI not only confirmed these findings but also revealed new information for further increasing specificity and sensitivity in detecting TFI.

Thirty antigens were preferentially recognized by TFI patients. At 1:800 dilution, HSP60 reacted with 22 of the 31 TFI sera (71% sensitivity) and 4 of the 23 IFC sera (82.6% specificity), which is consistent with previous findings and suggests that the ELISA described herein is comparable to other assays. When the sera were diluted to 1:4000 in order to further increase specificity, 10 of the 30 antigens achieved 100% specificity. Although the sensitivity decreased, careful examination revealed that a combination of 2 antigens [CT381 and CT443 (Outer membrane complex B, OmcB)], or 4 antigens [CT110 (HSP60), CT376, CT381 & CT798] detected TFI with a specificity and sensitivity of 100% and 67.7%, respectively. These combinations of antigens improved the *C. trachomatis* serology approach for diagnosing tubal infertility over using HSP60 alone (35.5% sensitivity), which represents a clinically significant improvement.

Hysterosalpingogram (HSG) has a detection specificity and sensitivity of 83% and 65% respectively for detecting tubal pathology (47). *C. trachomatis* antigen-based serology diagnosis has numerous advantages over HSG besides improved detection, including sparing patients from the discomfort, radiation, and potential for infectious sequellae. This conclusion is consistent with previous reports that elevated chlamydial antibody levels are comparable to HSG (48) in diagnosing TFI and that HSG does not add to the medical knowledge on whether *C. trachomatis* infection contribute to tubal pathology (49).

It is unknown whether these antigens themselves or antigen-specific immune responses contribute to the inflammatory pathologies in the fallopian tubes. The protein CT443, or OmcB, displayed the highest rate of reactivity with TFI patient sera. OmcB is a highly conserved immunodominant antigen, but the precise location of OmcB in the organisms and its role during infection is poorly understood (34, 50-52).

Despite the overwhelming evidence of *C. trachomatis* infection association with TFI, not every patient is infected with *C. trachomatis* or developed immune responses to *C. trachomatis*. Interventions such as early antibiotic therapy may cause a negative or low titer in patients, but it is unlikely that tubal pathology would be attributed to the *C. trachomatis* infection in these patients. Tubal pathology in TFI patients without positive *C. trachomatis* titers might be caused by other sources of infection such as *Neisseria gonorrhoeae* (53-54) and *Mycoplasma genitalium* (55-56). Thus, to further increase the sensitivity in diagnosing TFI, other infection causes should also be taken into account.

REFERENCES FOR EXAMPLE 1

1. Healy D L, Trounson A O, Andersen A N. Female infertility: causes and treatment. *Lancet* 1994; 343:1539-1544.
2. Musich J R, Behrman S J. Surgical management of tubal obstruction at the uterotubal junction. *Fertil Steril* 1983; 40:423-441.
3. Serafini P, Batzofin J. Diagnosis of female infertility. A comprehensive approach. *J Reprod Med* 1989; 34:29-40.
4. Wilkowska-Trojniel M, Zdrodowska-Stefanow B, Ostaszewska-Puchalska I, Zbucka M, Wolczynski S, Grygoruk C, et al. *Chlamydia trachomatis* urogenital infection in women with infertility. *Adv Med Sci* 2009; 54:82-85.
5. Confino E, Tur-Kaspa I, DeCherney A, Corfman R, Coulam C, Robinson E, et al. Transcervical balloon tuboplasty. A multicenter study. *JAMA* 1990; 264:2079-2082.

6. Grant A. Infertility surgery of the oviduct. *Fertil Steril* 1971; 22:496-503.
7. Malik A, Jain S, Rizvi M, Shukla I, Hakim S. *Chlamydia trachomatis* infection in women with secondary infertility. *Fertil Steril* 2009; 91:91-95.
8. Barlow R E, Cooke I D, Odukoya O, Heatley M K, Jenkins J, Narayansingh G, et al. The prevalence of *Chlamydia trachomatis* in fresh tissue specimens from patients with ectopic pregnancy or tubal factor infertility as determined by PCR and in-situ hybridisation; *J Med Microbiol* 2001; 50:902-908.
9. Stephens R S, The cellular paradigm of chlamydial pathogenesis. *Trends Microbiol* 2003; 11:44-51.
10. Cheng W, Shivshankar P, Zhong Y, Chen D, Li Z, Zhong G. Intracellular interleukin-1alpha mediates interleukin-8 production induced by *Chlamydia trachomatis* infection via a mechanism independent of type I interleukin-1 receptor. *Infect Immun* 2008; 76:942-951.
11. Ajonuma L C, Ng E H, Chan H C. New insights into the mechanisms underlying hydrosalpinx fluid formation and its adverse effect on IVF outcome. *Hum Reprod Update* 2002; 8:255-264.
12. Sharma M, Sethi S, Daftari S, Malhotra S. Evidence of chlamydial infection in infertile women with fallopian tube obstruction. *Indian J Pathol Microbiol* 2003; 46:680-683.
13. Cheng W, Shivshankar P, Li Z, Chen L, Yeh I T, Zhong G. Capase-1 contributes to *Chlamydia trachomatis*-induced upper urogenital tract inflammatory pathologies without affecting the course of infection. *Infect Immun* 2008; 76:515-522.
14. Lunenfeld E, Shapiro B S, Sarov B, Sarov I, Insler V, Decherney A H. The association between chlamydial-specific IgG and IgA antibodies and pregnancy outcome in an in vitro fertilization program. *J In Vitro Fert Embryo Transf* 1989; 6:222-227.
15. El Hakim E A, Epee M, Draycott T, Gordon U D, Akande V A. Significance of positive *Chlamydia* serology in women with normal-looking Fallopian tubes. *Reprod Biomed Online* 2009; 19:847-851.
16. Westrom L, Joesoef R, Reynolds G, Hagdu A, Thompson S E. Pelvic inflammatory disease and fertility. A cohort study of 1,844 women with laparoscopically verified disease and 657 control women with normal laparoscopic results. *Sex Transm Dis* 1992; 19:185-192.
17. Sziller I, Fedorcsak P, Csapo Z, Szirmai K, Linhares I M, Papp Z, et al. Circulating antibodies to a conserved epitope of the *Chlamydia trachomatis* 60-kDa heat shock protein is associated with decreased spontaneous fertility rate in ectopic pregnant women treated by salpingectomy. *Am J Reprod Immunol* 2008; 59:99-104.
18. Brunham R C, Maclean I W, Binns B, Peeling R W. *Chlamydia trachomatis*: its role in tubal infertility. *J Infect Dis* 1985; 152:1275-1282.
19. LaVerda D, Kalayoglu M V, Byrne G I. Chlamydial heat shock proteins and disease pathology: new paradigms for old problems? *Infect Dis Obstet Gynecol* 1999; 7:64-71.
20. Witkin S S, Jeremias J, Toth M, Ledger W J. Cell-mediated immune response to the recombinant 57-kDa heat-shock protein of *Chlamydia trachomatis* in women with salpingitis. *J Infect Dis* 1993; 167:1379-1383.
21. Toye B, Laferriere C, Claman P, Jessamine P, Peeling R. Association between antibody to the chlamydial heat-shock protein and tubal infertility. *J Infect Dis* 1993; 168:1236-1240.
22. Ault K A, Statland B D, King M M, Dozier D I, Joachims M L, Gunter J. Antibodies to the chlamydial 60 kilodalton heat shock protein in women with tubal factor infertility. *Infect Dis Obstet Gynecol* 1998; 6:163-167.
23. Dieterle S, Wollenhaupt J. Humoral immune response to the chlamydial heat shock proteins hsp60 and hsp70 in *Chlamydia*-associated chronic salpingitis with tubal occlusion. *Hum Reprod* 1996; 11:1352-1356.
24. Tiitinen A, Surcel H M, Halttunen M, Birkelund S, Bloigu A, Christiansen G, et al. *Chlamydia trachomatis* and chlamydial heat shock protein 60-specific antibody and cell-mediated responses predict tubal factor infertility. *Hum Reprod* 2006; 21:1533-1538.
25. Linhares I M, Witkin S S. Immunopathogenic consequences of *Chlamydia trachomatis* 60 kDa heat shock protein expression in the female reproductive tract. *Cell Stress Chaperones* 2010; 15:467-473.
26. Karinen L, Pouta A, Hartikainen A L, Bloigu A, Paldanius M, Leinonen M, et al. Antibodies to *Chlamydia trachomatis* heat shock proteins Hsp60 and Hsp10 and subfertility in general population at age 31. *Am J Reprod Immunol* 2004; 52:291-297.
27. Karinen L, Pouta A, Hartikainen A L, Bloigu A, Paldanius M, Leinonen M, et al. Association between *Chlamydia trachomatis* antibodies and subfertility in the Northern Finland Birth Cohort 1966 (NFBC 1966), at the age of 31 years. *Epidemiol Infect* 2004; 132:977-984,
28. Jakus S, Neuer A, Dieterle S, Bongiovanni A M, Witkin S S. Antibody to the *Chlamydia trachomatis* 60 kDa heat shock protein in follicular fluid and in vitro fertilization outcome. *Am J Reprod Immunol* 2008; 59:85-89.
29. Equils O, Lu D, Gatter M, Witkin S S, Bertolotto C, Arditi M, et al. *Chlamydia* heat shock protein 60 induces trophoblast apoptosis through TLR4. *J Immunol* 2006; 177:1257-1263.
30. Beatty W L, Byrne G I, Morrison R P. Repeated and persistent infection with *Chlamydia* and the development of chronic inflammation and disease. *Trends Microbiol* 1994; 2:94-98.
31. Campanella C, Marino Gammazza A, Mularoni L, Cappello F, Zummo G, Di Felice V. A comparative analysis of the products of GROEL-1 gene from *Chlamydia trachomatis* serovar D and the HSP60 var1 transcript from *Homo sapiens* suggests a possible autoimmune response. *International Journal of Immunogenetics* 2009; 36:73-78.
32. Kinnunen A, Molander P, Morrison R, Lehtinen M, Karttunen R, Tiitinen A, et al. Chlamydial heat shock protein 60-specific T cells in inflamed salpingeal tissue. *Fertil Steril* 2002; 77:162-166.
33. Kinnunen A, Surcel H M, Halttunen M, Tiitinen A, Morrison R P, Morrison S G, et al. *Chlamydia trachomatis* heat shock protein-60 induced interferon-gamma and interleukin-10 production in infertile women. *Clin Exp Immunol* 2003; 131:299-303.
34. Wang J, Zhang Y, Lu C, Lei L, Yu P, Zhong G. A genome-wide profiling of the humoral immune response to *Chlamydia trachomatis* infection reveals vaccine candidate antigens expressed in humans. *J Immunol* 2010; 185:1670-1680.
35. Zhong G, Fan P, Ji H, Dong F, Huang Y. Identification of a chlamydial protease-like activity factor responsible for the degradation of host transcription factors. *J Exp Med* 2001; 193:935-942.
36. Rodgers A K, Wang J, Zhang Y, Holden A, Berryhill B, Budrys N M, et al. Association of tubal factor infertility with elevated antibodies to *Chlamydia trachomatis* caseinolytic protease P. *Am J Obstet Gynecol* 2010; 203: 494 e497-494 e414.

37. Li Z, Chen D, Zhong Y, Wang S, Zhong G. The chlamydial plasmid-encoded protein pgp3 is secreted into the cytosol of *Chlamydia*-infected cells. *Infect Immun* 2008; 76:3415-3428.
38. Luo J, Liu G, Zhong Y, Jia T, Liu K, Chen D, et al. Characterization of hypothetical proteins Cpn0146, 0147, 0284 & 0285 that are predicted to be in the *Chlamydia pneumoniae* inclusion membrane. *BMC Microbiol* 2007; 7:38.
39. Wang J, Chen L, Chen F, Zhang X, Zhang Y, Baseman J, et al. A chlamydial type III-secreted effector protein (Tarp) is predominantly recognized by antibodies from humans infected with *Chlamydia trachomatis* and induces protective immunity in mice against inflammatory pathologies in the upper genital tract. *J Immunol* revision. 2008.
40. Sharma J, Zhong Y, Dong F, Piper J M, Wang G, Zhong G. Profiling of human antibody responses to *Chlamydia trachomatis* urogenital tract infection using microplates arrayed with 156 chlamydial fusion proteins. *Infect Immun* 2006; 74:1490-1499.
41. Dutta R, Jha R, Salhan S, Mittal A. *Chlamydia trachomatis*-specific heat shock proteins 60 antibodies can serve as prognostic marker in secondary infertile women. *Infection* 2008; 36:374-378.
42. Persson K, Osser S, Birkelund S, Christiansen G, Brade H. Antibodies to *Chlamydia trachomatis* heat shock proteins in women with tubal factor infertility are associated with prior infection by *C. trachomatis* but not by *C. pneumoniae*. *Hum Reprod* 1999; 14:1969-1973.
43. Gijsen A P, Land J A, Goossens V J, Leffers P, Bruggeman C A, Evers J L. *Chlamydia pneumoniae* and screening for tubal factor subfertility. *Hum Reprod* 2001; 16:487-491.
44. Sarov I, Lunenfeld E, Sarov B, Hanuka N, Rosenzweig R, Potashnik G, et al. *Chlamydia* specific IgG and IgA antibodies in women with obstructive infertility as determined by immunoblotting and immunoperoxidase assays. *Eur J Epidemiol* 1988; 4:216-223.
45. Arno J N, Yuan Y, Cleary R E, Morrison R P. Serologic responses of infertile women to the 60-kd chlamydial heat shock protein (hsp60). *Fertil Steril* 1995; 64:730-735.
46. Dadamessi I, Eb F, Betsou F. Combined detection of *Chlamydia trachomatis*-specific antibodies against the 10 and 60-kDa heat shock proteins as a diagnostic tool for tubal factor infertility: Results from a case-control study in Cameroon. *FEMS Immunology & Medical Microbiology* 2005; 45:31-35.
47. Swart P, Mol B W, van der Veen F, van Beurden M, Redekop W K, Bossuyt P M. The accuracy of hysterosalpingography in the diagnosis of tubal pathology: a meta-analysis. *Fertility & Sterility* 1995.64:486-491.
48. Mol B W, Dijkman B, Wertheim P, Lijmer J, van der Veen F, Bossuyt P M. The accuracy of serum chlamydial antibodies in the diagnosis of tubal pathology: a meta-analysis. *Fertility & Sterility* 1997; 67:1031-1037.
49. den Hartog J E, Lardenoije C M, Severens J L, Land J A, Evers J L, Kessels A G. Screening strategies for tubal factor subfertility. *Hum Reprod* 2008; 23:1840-1848.
50. Mygind P, Christiansen G, Persson K, Birkelund S. Analysis of the humoral immune response to *Chlamydia* outer membrane protein 2. *Clin Diagn Lab Immunol* 1998; 5:313-318.
51. Gervassi A L, Grabstein K H, Probst P, Hess B, Alderson M R, Fling S P. Human CD8+ T cells recognize the 60-kDa cysteine-rich outer membrane protein from *Chlamydia trachomatis*. *J Immunol* 2004; 173:6905-6913.
52. Goodall J C, Yeo G, Huang M, Raggiaschi R, Gaston J S. Identification of *Chlamydia trachomatis* antigens recognized by human CD4+ T lymphocytes by screening an expression library. *Eur J Immunol* 2001; 31:1513-1522.
53. Pellati D, Mylonakis I, Bertoloni G, Fiore C, Andrisani A, Ambrosini G, et al. Genital tract infections and infertility. *Eur J Obstet Gynecol Reprod Biol* 2008; 140:3-11.
54. Morales P, Reyes P, Vargas M, Rios M, Imarai M, Cardenas H, et al. Infection of human fallopian tube epithelial cells with *Neisseria gonorrhoeae* protects cells from tumor necrosis factor alpha-induced apoptosis. *Infect Immun* 2006; 74:3643-3650.
55. Svenstrup H F, Fedder J, Kristoffersen S E, Trolle B, Birkelund S, Christiansen G. 2008. *Mycoplasma genitalium, Chlamydia trachomatis*, and tubal factor infertility—a prospective study. *Fertil Steril* 2008; 90:513-520.
56. Haggerty C L, Evidence for a role of *Mycoplasma genitalium* in pelvic inflammatory disease. *Curr Opin Infect Dis* 2008; 21:65-69.

Example 2

*Chlamydia trachomatis* Antigens Recognized by Women with Tubal Factor Infertility, Normal Fertility and Acute Infection Abstract.

To identify C, trachomatis antigens associated with tubal factor infertility, a whole genome scale *C. trachomatis* proteome array was used to compare antibody specificity profiles among women with tubal factor infertility, normal fertility and acute *C. trachomatis* infection. Thirteen immunodominant antigens reacted with ≥50% antisera from all women. Ten *C. trachomatis* antigens were uniquely recognized by women diagnosed with tubal factor infertility. Assessing antigen fragments with serum sample dilution, chlamydial antigens HSP60, CT376, CT557 & CT443 could discriminate between women with tubal factor infertility and women with normal fertility at a sensitivity of 63% and specificity of 100%, respectively. However, these antigens also strongly reacted with antisera from women diagnosed with acute *C. trachomatis* infections. Nevertheless, women with an acute infection preferentially recognized a new set of 21 antigens. Of these, CT875 & CT147 together distinguished women with acute infection from all other *C. trachomatis*-exposed women with a detection sensitivity of 63% and specificity of 100%, respectively. A combination of both sets of antigens may be useful to screen all women for tubal factor infertility and identify acute *C. trachomatis* infection.

Introduction.

*Chlamydia trachomatis* is a leading cause of sexually transmitted bacterial infection (STI) in the US, affecting over one million women in 2008 alone (1). The incidence of *C. trachomatis* infection has steadily increased since it was first recorded in 1984, and continues to rise yearly. *C. trachomatis* infection is often undiagnosed and untreated because it is asymptomatic. If untreated, *C. trachomatis* infection may lead to ascending infection, causing complications such as ectopic pregnancy and tubal factor infertility (1-2). However, not all women infected with *C. trachomatis* develop tubal damage. Up to 50% of women with normal fallopian tubes on laparoscopy or normal fertility have developed high titers of anti-*C. trachomatis* antibodies (3). It is not clear what determines whether a *C. trachomatis*-exposed woman will develop tubal pathology and complications. Nevertheless, the severity and number of episodes of *C. trachomatis* infection can contribute to tubal pathology. Since host immune responses reflect both infection status and host responsiveness to infection, monitoring specific antibody responses to *C. trachoma-* tis infection may lead to the identification of biomarkers that correlate with tubal pathology. Women with robust antibody responses to the *C. trachomatis* major outer membrane protein (MOMP) are less likely to develop tubal pathology while those who generate high titers of anti-HSP60 antibodies are at a significantly higher risk of developing tubal factor infertility (TFI) (4). High resolution mapping of host antibody responses to *C. trachomatis* infection may aid in the identification of *C. trachomatis* antigens associated with TFI.

Previous studies have revealed a strong association of anti-*C. trachomatis* and anti-HSP60 antibodies with TFI (3-9). Using a high-resolution whole genome scale protein array assay, the profiles of antigen specificities of anti-C, trachomatis antibodies were compared between women with TFI and women with infertility due to other causes (infertility control, IFC). The association of HSP60 antibodies with TFI was confirmed and additional new *C. trachomatis* antigens associated with TFI were identified (5). However, these and other studies focused on well-defined study subjects for comparison. When more diverse patient populations were included in the comparison, the anti-*C. trachomatis* and HSP60 antibodies no longer significantly correlated with tubal factor infertility or subfertility (10). The goal of the current study is to identify *C. trachomatis* antigens that are preferentially recognized by different groups of women with diverse socio-economic status. It was found that *C. trachomatis* antigens such as HSP60, which have previously been shown to be associated with TFI (5), were also highly reactive with anti-sera from women with acute *C. trachomatis* urogenital tract infection. Thus, TFI-associated antigens including HSP60 cannot predict tubal factor infertility in the general female population. Here, a whole genome scale proteome array was used to define a set of 21 antigens for distinguishing women with acute *C. trachomatis* infection from other *C. trachomatis*-exposed women. It is demonstrated that distinct panels of *C. trachomatis* antigens may be used to predict pathology and/or clinic phenotypes caused by *C. trachomatis* infection.

Human Subjects.

All patients were enrolled at the University of Texas Health Science Center at San Antonio after receipt of Institutional Review Board (IRB) approval. All participants underwent a single blood draw. Serum samples were stored at −20° C. until analyzed. Subjects were composed of three distinct socioeconomic and demographic groups. The TFI group (N=24) was recruited from a university-based infertility clinic. The typical payer mix is 13% privately insured, 69% self pay, and 18% military. Subjects with TFI were eligible if they were at least 21 years of age and had a pelvic laparoscopy demonstrating hydrosalpinx, fimbrial phimosis, or peritubal adhesions. Exclusion criteria included prior tubal ligation, surgical finding of endometriosis, or a history of pelvic infection or inflammation other than pelvic inflammatory disease, such as appendicitis. The fertile control (FC) group (N=25) was recruited from a university affiliated county hospital. The typical payer mix is 31% privately insured, 29% Medicare, 36% Medicaid. FC subjects were eligible if they were at least 21 years of age and had at least one live birth and normal pelvic findings at the time of tubal ligation. FC patients were enrolled at the time of their scheduled tubal ligation. Sterilization was performed either via laparoscopy or via mini-laparotomy. The sexually transmitted infection (STI) group (N=24) was referred by the health department to a university based STI clinic after diagnosis of any sexually transmitted infections or diseases. Patients reported their insurance as 11% privately insured, 25% Medicaid, 25% uninsured and 14% did not respond. STI patients were eligible if they were of reproductive age (15-45 years of age) and had a recent diagnosis of *C. trachomatis* infection. The diagnosis was based on positive *C. trachomatis* nucleic acid detection in vaginal swab samples as described previously (11-12). Blood was taken within 2 weeks of the diagnosis.

Cell Culture and Chlamydial Infection.

As previously described (13-14), HeLa cells (American Type Culture Collection) were cultured in Dulbecco's minimum essential medium (DMEM; GIBCO) with 10% fetal calf serum (GIBCO) at 37° C. with 5% $CO_2$. *C. trachomatis* serovar D or *C. pneumoniae* AR39 organisms were grown, purified, and titrated as previously described (3, 5, 13, 15). For immunofluorescence assay, chlamydial organisms were used to infect HeLa cells grown on glass coverslips in 24-well plates. The subconfluent HeLa cells were treated with DMEM containing 30 mg/mL of DEAE-Dextran (Sigma) for 10 minutes at 37° C. After removal of DEAE-Dextran solution, chlamydial organisms were added to the wells for 2 hours at 37° C. The infected cells were continuously cultured in DMEM with 10% fetal calf serum and 2 mg/mL of cycloheximide (Sigma) for 48 h (*C. trachomatis*) or 72 h (*C. pneumoniae*) before sample processing.

Immunofluorescence Assay.

Antichlamydial organism antibodies in human sera were titrated using an immunofluorescence assay as previously described (3, 5). Briefly, HeLa cells grown on coverslips were infected with *C. trachomatis* or *C. pneumoniae* organisms, fixed with 2% paraformaldehyde, and permeabilized with 2% saponin at room temperature for 1 hour. After blocking, human sera were added to the *Chlamydia*-infected cell samples. The primary antibody binding was visualized with a goat anti-human IgG conjugated with Cy3 (red; Jackson ImmunoResearch Laboratories), and DNA was labeled with Hoechst dye (blue; Sigma-Aldrich). The highest dilution of a serum that still gave a positive reactivity was defined as the titer of the given serum sample. Serum samples were serially diluted, and the appropriate dilutions were repeated multiple times according to the results obtained from prior dilutions, to obtain a more accurate titer for each serum. Images were acquired with an Olympus AX70 fluorescence microscope equipped with multiple filter sets, as previously described (16-17).

Chlamydial Fusion Protein-Arrayed Microplate ELISA.

Glutathione S-transferase (GST) fusion protein ELISA for detecting human antibody recognition of chlamydial proteins was carried out as previously described (11-12). Bacterial lysates containing individual chlamydial GST fusion proteins were added to 96-well microplates precoated with glutathione (Pierce) at a 1:10 dilution in PBS, with a total volume of 200 µL per well. Lysates containing GST alone, as negative, and GST-chlamydial protease/proteasome-like activity factor (CPAF), as positive controls, were also included on each plate. The plates were incubated overnight at 4° C. to allow GST fusion proteins to bind to the plate-immobilized glutathione, then blocked with 2.5% milk in phosphate-buffered saline (PBS) and washed with PBST (PBS with 0.05% Tween 20; Sigma-Aldrich). The human sera were preabsorbed with a bacterial lysate containing GST at 4° C. overnight, then incubated with glutathione beads (bioWorld) for 1 hour at room temperature to reduce background caused by nonspecific human antibodies. The human antibody reactivity was detected with a goat anti-human IgG, IgA, and IgM conjugated with horseradish peroxidase (Jackson ImmunoResearch Laboratories) plus the substrate 2,20-azino-bi (2-ethylbenzothiazoline-6-sulforic acid)diammonium salt (Sigma). The optical density (OD) was measured at 405 nm using a microplate reader (Molecular Devices). To confirm the antibody binding specificity, all sera were further absorbed with lysates made from either HeLa cells alone or *C. trachomatis* serovar D-infected HeLa cells before reacting with the fusion protein-coated plates. The absorption was carried out as follows: HeLa cells with or without chlamydial infection were lysed via sonication at $2 \times 10^7$ cells per milliliter of PBS containing a cocktail of protease inhibitors. The prediluted serum samples were incubated with cell lysates overnight at 4° C. before reacting with the plate-immobilized chlamydial fusion proteins. The antibody binding that remained positive after HeLa-alone lysate absorption but significantly reduced by *Chlamydia*-HeLa lysate absorption was considered true positive.

Data Analyses.

Data were analyzed using Microsoft Excel 2007. ANOVA was used to compare anti-*C. trachomatis* and anti-*C. pneumoniae* antibody titers between all three groups of patients. Student's t-Test was used to identify statistical differences between given two groups. Results from ELISA were analyzed using both Student's t-Test (for comparing quantitative OD value data) and Chi-squared or Fisher's Exact test (for comparing the number of sera positively reacted with a given antigen). Combination of these two methods allowed for the identification of *C. trachomatis* antigens that are both clinically and statistically significant. When Student's t-Test was used, the OD values after subtracting background from the same plate were used. When the Chi squared test was used, positive reactivity frequency was used. A reaction was determined positive when the OD value was 2 standard deviations (SD) above the mean calculated from the same 96-well plate (5).

Overall Anti-*C. trachomatis* and Anti-*C. pneumoniae* Antibodies in Three Groups of Women.

Serially diluted serum samples from women with tubal factor infertility (TFI), normal fertility (FC) and acute *C. trachomatis* infection (STI) were reacted with *C. trachomatis* and *C. pneumoniae*-infected HeLa cells to measure the titers of the corresponding antibodies (Table 3). STI women displayed the lowest levels of anti-*C. pneumoniae* antibodies compared to TFI and FC groups (P<0.05 for both, Student's t-Test) while TFI and FC displayed similar levels of the antibodies (p=0.34). The distribution of anti-*C. pneumoniae* antibodies correlated well with the age distribution among the three groups of women. STI women were significantly younger (mean age 21.8±3.1 years) than both TFI (34.6±4.4, p<0.05) and FC (32.5±5.7, p<0.05), respectively, while the TFI and FC women displayed similar ages (p>0.05). These results are consistent with a general concept that anti-*C. pneumoniae* antibody levels increase as age increases (18-19).

However, the anti-*C. trachomatis* antibody titers were highest in the STI group compared to those in either the TFI or FC groups (p=0.0748 & p=0.0099, respectively) while there was no significant difference between TFI and FC groups (p=0.2229). The STI group was significantly younger than both the TFI and FC groups as noted above. Thus, in contrast to the age-dependent increase in anti-*C. pneumoniae* antibody titers, the anti-*C. trachomatis* antibody titers decreased as age progressed, probably due to reduced exposure to *C. trachomatis*. This observation is consistent with CDC data showing that adolescents and young women ages 15 to 24 are at the highest risk for STIs (2). Although the titer of anti-*C. trachomatis* antibodies in TFI women (35483.33±39950.49) appeared to be higher than that in FC women (23760.00±23974.4), the difference was not statistically significant (p=0.2229), which stands in contrast to the previous report that women with tubal factor infertility displayed significantly higher levels of anti-*C. trachomatis* antibodies than women with infertility due to non-tubal causes (3, 5). The previous studies focused on infertile women recruited from an infertility clinic while the above analysis compared tubal factor infertility women from the infertility clinic with women of normal fertility. Clearly, when diverse female populations are included, the overall anti-*C. trachomatis* antibody levels are no longer associated with tubal factor infertility. A whole genome scale protein array was used next to profile antigen-specificities of antibodies in the serum samples from this diverse population of women.

Genome-Wide Antibody Profiles Reveal Immunodominant Antigens Commonly Recognized by all Three Groups of Women.

Anti-*C. trachomatis* antibodies from 24 TFI, 25 FC and 24 STI women were profiled for their antigen-specificities at a genome-wide scale. These 73 antisera recognized *C. trachomatis* antigens distributed across the entire genome with 541 antigens recognized by at least one antiserum and 367 antigens not detected by any antisera. Many *C. trachomatis* antigens were recognized by all 3 groups of women although some antigens were preferentially recognized by individual or combinations of groups. Regardless of which groups the women were from, 50% or more of the 73 women recognized a total of 13 antigens, including pCT03 (93% frequency) (Pgp3, a plasmid-encoded hypothetical protein that is secreted into host cell cytosol (20-21)), CT858 (90% frequency) (CPAF, a chlamydial protease/proteasome-like activity factor known to be secreted into host cell cytosol (14)), CT101 (79% frequency) (hypothetical protein, HP), CT841 (77% frequency) (FtsH, ATP-dependent Zinc protease), CT240 (73% frequency) (Recombination protein RecR), CT443 (73% frequency) (outer membrane complex protein B, OmcB (22)), CT142 (60% frequency) and CT143 (71% frequency) (both HPs), CT813 (68% frequency) and CT529 (62% frequency) (both inclusion membrane proteins, Incs (23, 24)), CT694 (66% frequency) (a putative effector of the type III secretion pathway (25)), CT022 (55% frequency) (50S ribosomal protein L31 type B) and CT806 (55% frequency) (insulinase family/protease III, Ptr). These proteins are designated as immunodominant antigens in these women.

Identification of Antigens Preferentially Recognized by TFI Women.

Figure 3:
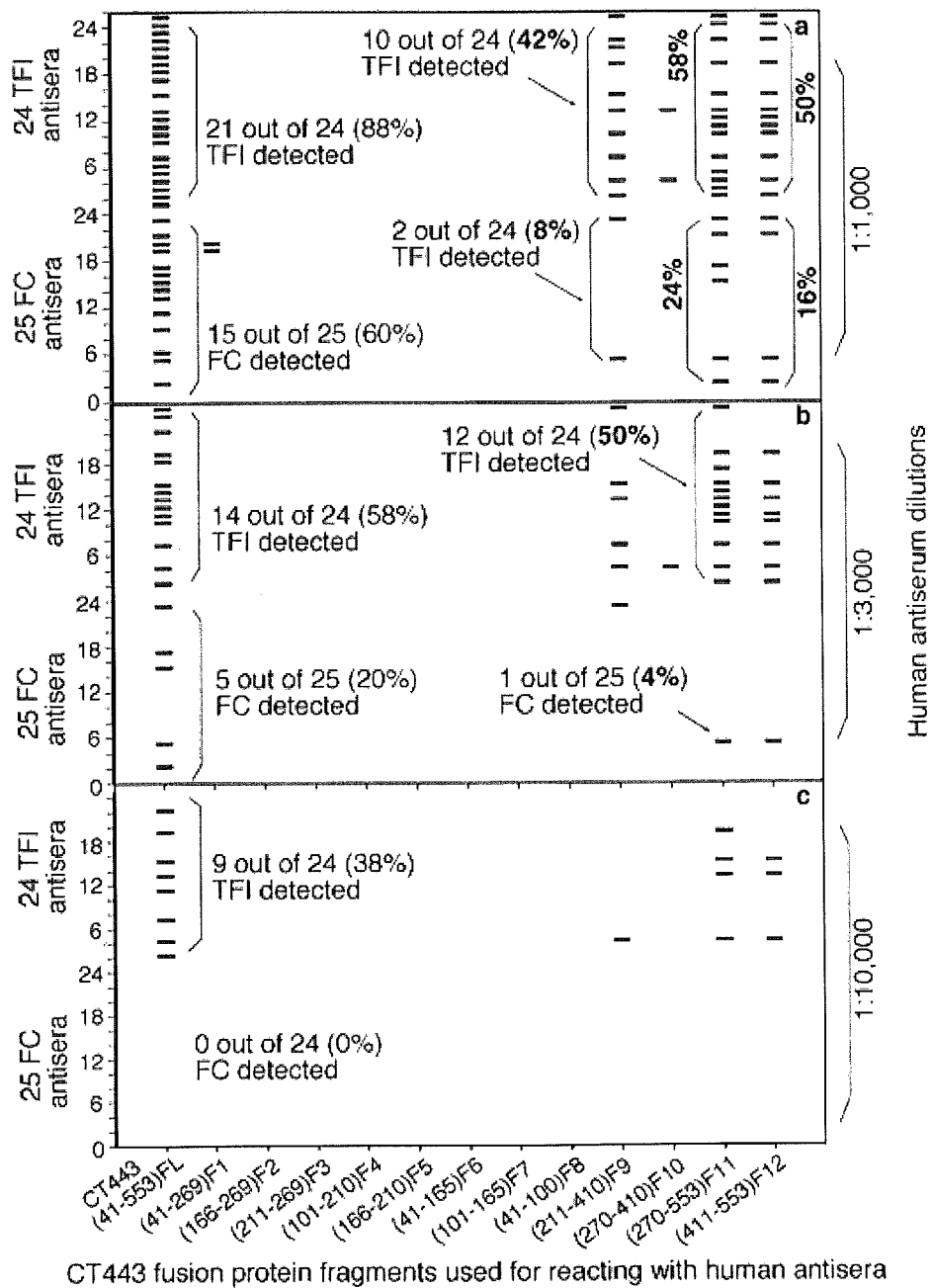
FIGS. 3A-C. Reactivity Patterns of CT443 and its 12 Fragments with TFI & FC Serum Samples. CT443 full length (FL) and its 12 fragments (F1 to F12) as shown along the X-axis at the bottom were reacted with 24 TFI and 25 FC antisera (listed along the Y-axis on the left) at different dilutions (as shown along the Y-axis on the right), including 1:1,000 (A), 1:3,000 (B) and 1:10,000 (C). A positive reactivity was indicated with a horizontal bar. Number of or percentage of antisera reacted with a given antigen were spelled out in text in corresponding panels. Please note that most antibody reactivity was localized at the C-terminal fragments, including fragment 10 (F9), F11 and F12 and the fragments displayed better discrimination of TFI from FC samples than the full length CT443 at different serum dilutions.
Figure 4:
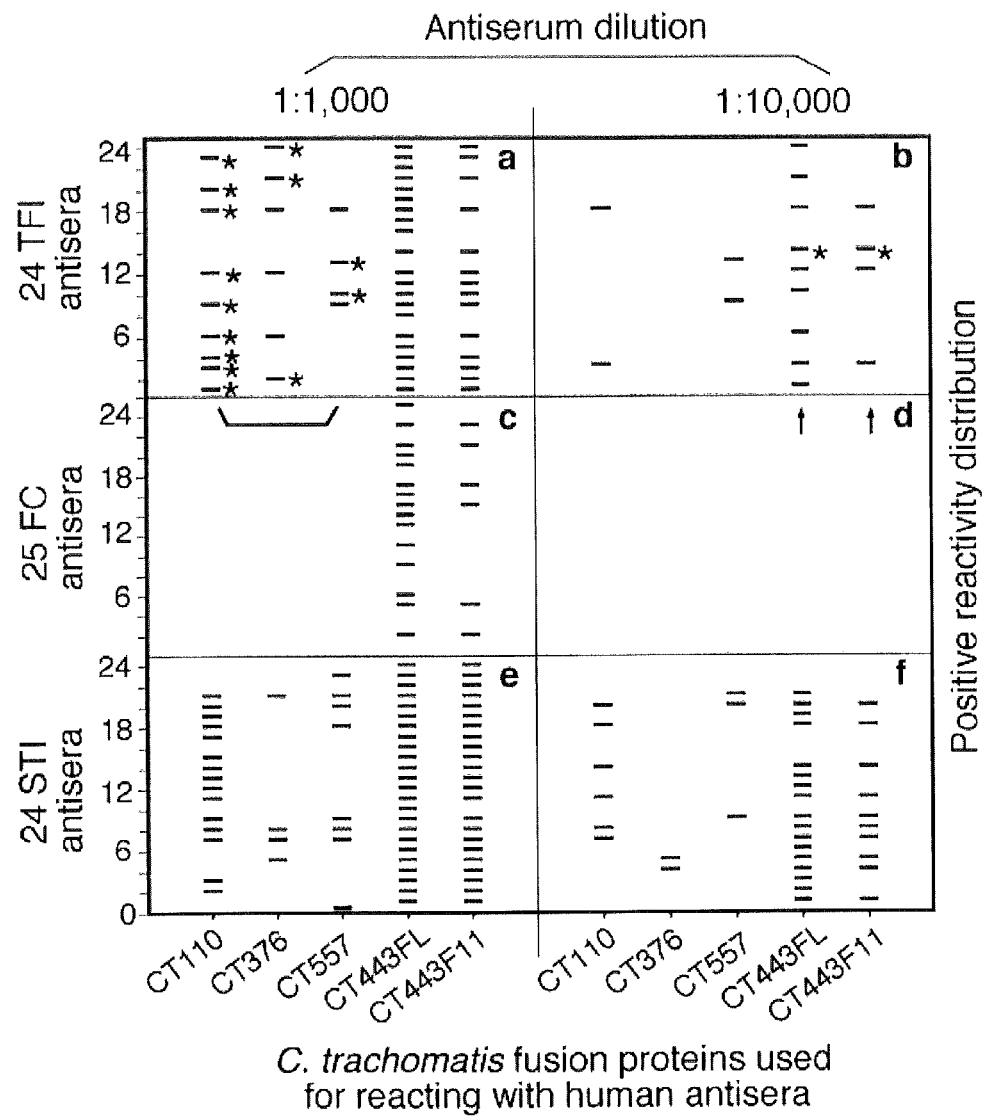
FIGS. 4A-F. Reactivity Patterns of Antigens Preferentially Recognized by TFI Women with Serum Samples from 3 Different Groups of Women. The reactivity of CT110, CT376, CT557, CT443 and CT443F11 as listed along the X-axis at the bottom with 24 TFI (A-B), 25 FC(C-D) and 24 STI (E-F) antisera as shown along the Y-axis at the left side. A positive reactivity was indicated with a horizontal bar. The human sera were used at either 1:1000 (A, C, E) or 1:10,000 (B, D, F) dilution. Antisera from the TFI group uniquely detected by a given antigen are marked with stars. Antigens preferentially recognized by TFI women were also highly reactive with STI women samples.
Figure 5:
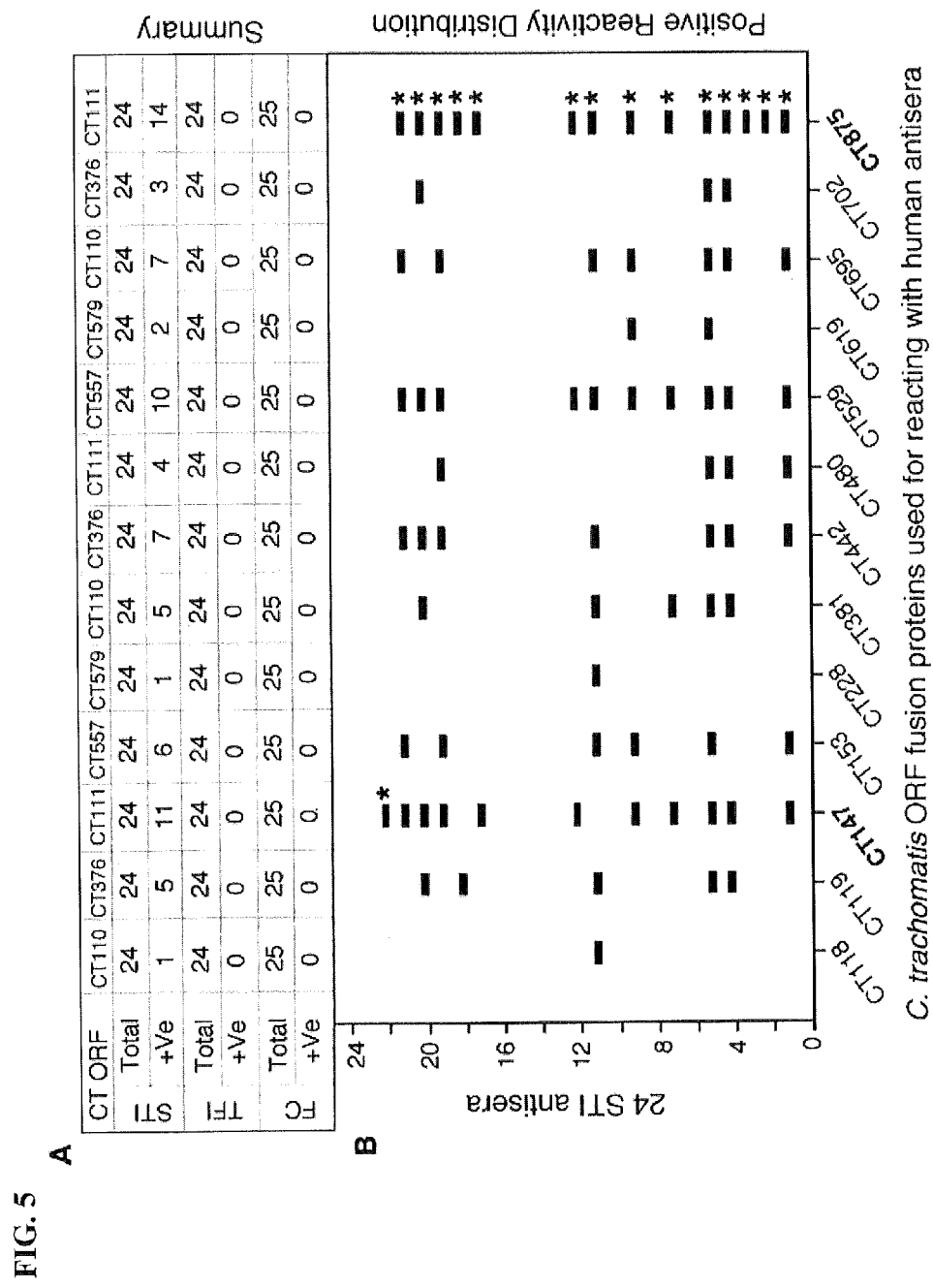
FIGS. 5A-B. Reactivity Patterns of 13 Antigens with STI Women Samples. When the 21 antigens listed in Table 5 were reacted with human sera at 1:10,000 dilution, 13 antigens (listed at top and bottom of the figure) completely lost reactivity with either TFI or FC women samples but each maintained a certain level of reactivity with STI samples as summarized in panel A. The patterns of reactivity of the 13 antigens with 24 STI samples are shown in panel B. Each horizontal bar indicates a positive reactivity and antisera uniquely reacted with CT875 and CT147 are marked with a star. CT875 and CT147 detected 15 out of the 24 STI sera with a sensitivity of 63% while maintaining 100% specificity.

The reactivity of the antiserum samples with each of the 908 *C. trachomatis* antigens was compared between the 3 groups of women both quantitatively (comparison of OD values using ANOVA) and qualitatively (comparison of recognition frequency using Fisher's Exact test). Antigens that displayed statistically significant differences in antibody reactivity (either quantitatively or qualitatively) and were recognized by 10% or more of the antisera from at least one group of women were selected. There were a total of 97 antigens that met both the above requirements. The use of 10% cutoff for recognition frequency was set to eliminate antigens with extremely low reactivities that were no longer biologically significant, although statistically significant. Many antigens shown at the bottom half of the figure were visually identifiable as antigens preferentially recognized by women from one or two groups but not all groups. Since a major goal of the current study is to identify TFI-associated antigens, the antigens that displayed statistically significant differences in recognition by TFI versus FC women were analyzed first (Table 4). Among the 10 antigens that were preferentially recognized by TFI women, 5 failed to react with any antisera from FC women under the current serum dilution (1:1000), suggesting that these antigens can distinguish TFI from FC women with 100% specificity. When the reactivity patterns of these 5 antigens with TFI women were revealed (FIG. 2), it was found that CT110, the chlamydial HSP60, reacted with antisera from 9 out of 24 TFI women, thus with a detection sensitivity of 38%. Antigen CT376 reacted with additional 3 TFI samples while CT557 reacted with another 2 TFI samples. Together, these 3 antigens detected TFI samples with a sensitivity of 58% while still maintaining 100% specificity. Among the remaining 5 antigens recognized by both TFI and FC women, CT443, the outer membrane complex protein B (OmcB) was recognized by TFI women with the highest frequency and intensity (both were significantly higher compared to FC women). Testing was done to determine whether a combination of human serum dilution and CT443 fragments could help to further differentiate TFI from FC women (FIG. 3). The CT443 full length (FL) proteins were expressed in 12 different fragments, all of which were used to react with both TFI and FC women antisera at different dilutions. Only the fragments representing the C-terminal portion of CT443, including fragments 9 (F9), 11 and 12, were reactive with human antisera. Nevertheless, at each human serum dilution, the CT443 fragments produced significantly greater differences than the full length CT443 did in antibody reactivity between TFI and FC samples. For example, at 1:1000 dilution of human sera, the full length CT443 reacted with 88% of TFI and 60% of FC women (a 32% decrease in reactivity with FC women antibodies) while F9 reacted with 42% TFI and only 8% FC (81% decrease), F11 reacted with 58% TFI and 24% FC (59% decrease) and F12 reacted with 50% TFI and 16% FC (48% decrease). When the human antiserum was used at 1:3000 dilution, F11 still reacted with 50% TFI but only 4% FC, representing a 92% decrease in reactivity with FC. Only one of the 25 FC antisera remained reactive with F11. Further modification of F11 may lead to the elimination of the FC reactivity while maintaining high levels of reactivity with TFI. These results have provided proof of principle that fragmentation of immunodominant cross-reactive antigens may represent a viable approach for identifying antigens with increasing differential diagnosis power. Interestingly, when human sera were diluted to 1:10,000, the full length CT443 no longer reacted with any FC women samples but retained reactivity with 38% of TFI samples, suggesting that serum sample dilution may represent another strategy to increase the ability to differentiate between women with different phenotypes. When the reactivity patterns of CT443 and its fragment 11 were compared with those of HSP60, CT376 and CT557, one additional TFI antiserum was detected (FIGS. 4A-B). Thus, a combination of these 4 antigens achieved a detection sensitivity of 63% for TFI women while still maintaining 100% detection specificity when both TFI and FC women were included.

Identification of Antigens Preferentially Recognized by Women with Acute *C. trachomatis* Infection.

When the antigens that were demonstrated to be able to discriminate TFI from FC samples with 100% specificity were applied to women diagnosed with acute *C. trachomatis* infection from a STI clinic, these antigens also strongly reacted with the STI serum samples even when the samples were highly diluted (FIG. 4). This is because STI women were all diagnosed with acute *C. trachomatis* infection when sera were collected and they developed high titers of antibodies to many antigens as revealed in Table 3. Fortunately, the whole genome scale proteome array also allowed the identification of *C. trachomatis* antigens that were preferentially recognized by STI but not TFI women (Table 5). A total of 21 antigens that displayed the greatest differences in reactivity between STI and TFI women were selected based on both quantitative and qualitative statistical analyses. It appeared that all 21 antigens strongly reacted with samples from patients with STIs, but were poorly recognized by either TFI or FC women serum samples. For example, when human serum samples were diluted at 1:1000, CT147 reacted with 88% of STI, but only 21% of TFI or 16% of FC samples and CT875 was recognized by 75% STI women, but only 17% of TFI or 16% FC women. Clearly, these 21 antigens were highly associated with acute infection since only the STI women were detected positive for *C. trachomatis* DNA in vaginal swab samples at the time when sera were taken while neither TFI nor FC women displayed any sign of acute *C. trachomatis* infection. These antigens could be used to distinguish STI patients from those in other groups. These antigens have been designated as acute infection-associated antigens. When human serum samples were diluted at 1:10,000, 13 of the 21 acute infection-associated antigens maintained positive reactivity with STI samples, but failed to react with any serum samples from either TFI or FC women (FIG. 5). The reactivity patterns of these 13 acute infection-associated antigens revealed that CT875 reacted with 14 out of the 24 STI serum samples. CT147 reacted with an additional STI sample (although the rest reacted with STI samples already detected by CT875 and CT147). Thus, antigens CT875 and CT147 together can be used to distinguish STI women from the rest of women with a detection sensitivity of 63% and a specificity of 100%. Continuing optimization of the detection system and use of acute infection-associated antigen fragments may allow for further increases in detection sensitivity while maintaining high specificity.

Table 3 shows titers of antibodies against *C. trachomatis* and *C. pneumoniae* in women with tubal factor infertility (TFI), normal fertility (FC) or acute infection (STI). Serum samples from women with TFI, FC, or STI were 2-fold serially diluted starting with 1:10 and reacted with HeLa cells infected with either *C trachomatis* or *C pneumoniae*. The highest dilution that still gave a positive reactivity was defined as the serum titer. ANOVA was used to analyze the overall differences among the 3 groups. There is a statistically significant difference in titers of antibodies against both *C. trachomatis* and *C. pneumoniae*. However, further pairwise analyses with Student's t-Test reveals significantly higher titers of anti-*C. trachomatis* but lower titers of anti-*C. pneumoniae* antibodies in STI women.

Table 4 shows antigens preferentially recognized by women with tubal factor infertility (TFI) but not normal fertility (FC). When Fisher's Exact test and Student's t-Test were used to compare each of 908 protein reactivities between TFI and FC groups, 10 antigens displayed statistically significantly differences by either method. Their corresponding ORF names, reactivity frequency (Freq) and intensity (OD values: mean plus/minus standard deviations) along with the p values were listed in corresponding columns. Five of the 10 antigens (CT110, CT376, CT111, CT557 & CT579) reacted with no FC samples.

Table 5 shows antigens that are most significantly recognized by women with acute *C. trachomatis* infection. Each of the 541 human antibody-reactive *C. trachomatis* antigens was compared for their reactivities with antisera from STI versus TFI or FC women using Student's t-Test (for comparing OD values in mean plus/minus standard deviations) and Fisher's Exact Test (for comparing reactive frequencies, Freq; a positive reaction was identified if the OD value is equal to or above the mean plus 2 standard deviations). Antigens that displayed the most differences and were recognized by STI women with a recognition frequency of 30% or higher were selected. A total of 21 antigens met the two requirements and were listed from top to bottom based on the extent of differential recognition by STI versus TFI or FC women. The reactivity was measured using a human serum dilution of 1:1000. All antigens were highly reactive with STI women samples and significantly less reactive with both TFI and FC samples.

In this study, the whole genome scale proteome array analyses have been extended to women with TFI, normal fertility or acute infection from a diverse socioeconomic group of women in San Antonio, Tex. The overall goal is to define C. trachomatis antigens that can be used to differentiate women with different clinical phenotypes after C. trachomatis infection with a focus on identifying biomarkers for predicting/diagnosing tubal factor infertility. The 3 groups of women recruited into the current study can largely represent the general female population since their overall anti-C. pneumoniae antibody levels increase as ages progress as demonstrated in other populations of women (18-19) while the overall anti-C. trachomatis antibody levels are the highest in STI women with an age range that is known to be most susceptible to C. trachomatis infection in the US (2). Although the 3 groups of women recognized many common antigens, quantitative and qualitative statistical analyses have allowed for the identification of 10 antigens that were preferentially recognized by TFI but not FC groups. Using serum sample dilution and antigen fragmentation to increase differentiating capacity, a 4-antigen combination consisting of HSP60, CT376, CT557 and CT443 distinguished tubal factor infertility from normal fertility women with a detection sensitivity of 63% and specificity of 100%. However, these same antigens also strongly reacted with antisera from women diagnosed with acute C. trachomatis from a STI clinic. Fortunately, the whole genome proteome array has led to the identification of 21 antigens that are highly associated with acute infection, two of which, CT875 & CT147, distinguished women with acute infection from other C. trachomatis-exposed women with a detection sensitivity of 63% and specificity of 100%. Thus, it is possible to use a combination of antigens to screen all women for predicting/diagnosing chlamydial infection and diseases.

Many previous studies have shown an association of anti-C. trachomatis antibodies with tubal factor infertility or subfertility (3, 5-7). Many of these studies focused on the comparison between women with tubal factor infertility and infertile women due to non-tubal causes but both visiting the same infertility clinics. However, when more diverse female populations were analyzed and included in the comparison, the anti-C. trachomatis antibodies were no longer significantly higher in patients with tubal factor infertility (10). In the current study, no statistically significant difference in anti-C. trachomatis antibody titers was found between women diagnosed with tubal factor infertility from a infertility clinic and women with normal fertility undergoing tubal ligation procedures. Thus, the overall anti-C. trachomatis antibodies, although highly associated with tubal factor infertility when compared to infertile women, cannot predict tubal factor infertility among C. trachomatis-exposed women.

Figure 6:
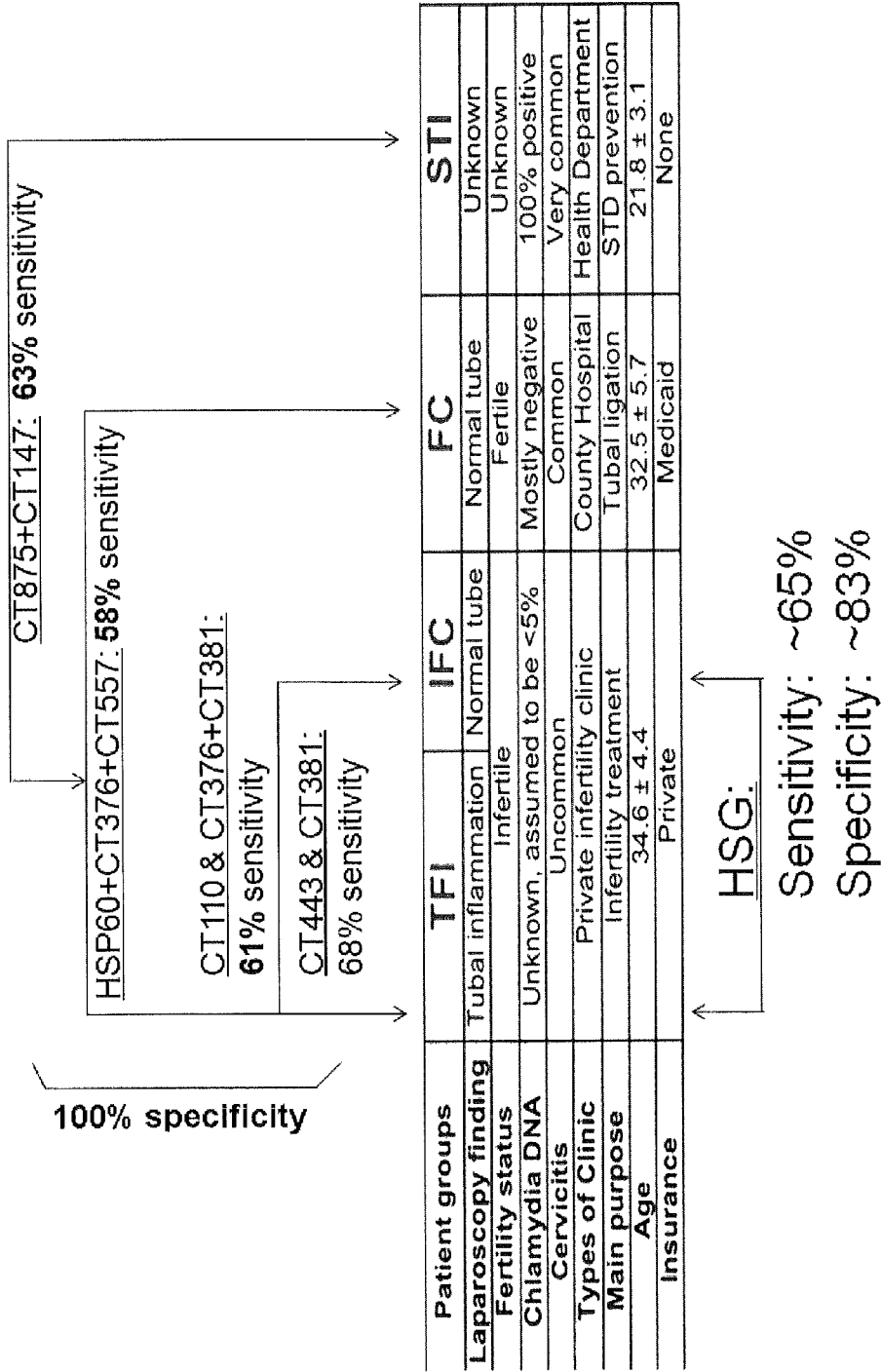
FIG. 6. Comparison of *Chlamydia* Antibody Test with Hysterosalpingogram (HSG) for Identifying Tubal Factor Infertility (TFI).

It has been previously shown that chlamydial HSP60 detected tubal factor infertility with a sensitivity of 36% and a specificity of 100% while a combination of antigens CT443 and CT381 provided a detection sensitivity of 68% while still maintaining 100% specificity (5). In the current study, when the antigen specificity profiles of anti-C. trachomatis antibodies in the TFI women were compared with those in FC women undergoing tubal ligation, these previous overall findings still held true. The chlamydial HSP60 along with antigens CT376 & CT557 positively detected 14 out of the 24 TFI samples with a sensitivity of 58%, but failed to react with any serum samples from FC women (100% specificity) (FIG. 6). CT443 or OmcB (outer membrane complex protein B) was found to react with serum samples only from tubal factor but not non-tubal infertility patients in the previous study (5). Although CT443 was recognized by both TFI and FC women in the current study, the reactivity of CT443 with TFI women was significantly stronger than that with FC women.

Using antigen fragmentation and serum dilution, it was possible to increase specificity of this diagnosis. By increasing the serum dilution, CT443 or CT443 fragments were able to differentiate TFI from FC samples. Using a dilution of 1:3,000, CT443 F11 reacted with 50% TFI but only 4% FC. Additional modifications of F11 may eliminate the residual FC reactivity. Further dilution of human sera to 1:10,000 completely removed the reactivity of CT443 with FC samples but allowed reactivity of CT443 with 38% of TFI samples. Together, these observations have provided a proof of principle that serum dilution and fragmentation of immunodominant cross-reactive antigens may represent viable approaches for identifying biomarkers to diagnose pathologies or predict clinic phenotypes associated with C. trachomatis.

Although the antigens identified above can distinguish TFI from FC women with 100% specificity, these antigens were also found to be strongly reactive with serum samples from women diagnosed with acute C. trachomatis infection from a STI clinic. Fortunately, the power of the whole genome scale proteome array has also allowed or the identification of 21 C. trachomatis antigens that were preferentially recognized by STI but not TFI nor FC women. Two of the 21 acute infection-associated antigens, CT875 and CT147, distinguished STI women from TFI and FC women with a detection sensitivity of 63% and a specificity of 100%. Continued optimization of the detection system and use of acute infection-associated antigen fragments may allow for further increases in detection sensitivity while maintaining high specificities. The observation that the acute infection-associated antigens were all poorly recognized by both TFI and FC women suggests that women in the TFI and FC groups were exposed to C. trachomatis in the past without ongoing infection. All STI women were detected positive for C. trachomatis DNA in vaginal swab samples at the time when sera were taken (11-12). However, the C. trachomatis status in either TFI or FC women was not specifically monitored when blood samples were collected. Nevertheless, physical examination revealed that none of the TFI and FC women displayed any sign of acute C. trachomatis infection in the lower genital tract (data not shown) and the nucleic acid detection rate was very low in patients who visited the same infertility or OB/GYN clinics in the past. Thus, the acute infection-associated antigens may represent useful biomarkers for indicating recent infection.

Identification of biomarkers associated with pathologies and/or clinic phenotypes caused by C. trachomatis infection will not only provide safer means for diagnosis or prognosis of C. trachomatis infection and diseases but may also promote better understanding of the mechanisms of C. trachomatis pathogenesis. It is widely believed that the association of chlamydial HSP60 with TFI suggests a role of HSP60 or host immune responses to HSP60 in tubal pathologies. Due to the high degree of amino acid sequence homology between chlamydial and human HSP60, anti-chlamydial HSP60 antibodies may cross-react with host HSP60 (26-27) or anti-HSP60 T cell responses may attack fallopian tube tissues (28-29). However, a recent study has shown that although antibodies reactive with chlamydial HSP60 were significantly higher in TFI women than those in control group, antibodies reactive with human HSP60 were at similar levels in both groups (30), suggesting that the anti-HSP60 cross-reactive antibodies may not significantly contribute to chlamydial pathogenesis. Chlamydial HSP60 has been shown to activate inflammatory pathways in macrophages (31), which may allow HSP60 to exacerbate inflammatory damage in fallopian tubes. The other *C. trachomatis* antigens that are significantly associated with TFI including CT376, CT557 & CT443 may also contribute to tubal pathology. Both CT376 and CT557 are highly conserved metabolic enzymes: malate dehydrogenase (334 amino acids) and dihydrolipoamide dehydrogenase (pyruvate dehydrogenase E3 component, 465 amino acids), respectively. These enzymes share high degrees of amino acid sequence homology with their host counterparts with 43% for CT376 and 38% for CT557, respectively. These metabolic enzymes are supposed to be localized in the cytoplasm of chlamydial organisms and should not be leaked into host cells during chlamydial infection. As with the cytoplasmic HSP60, CT376 and CT557 may be released into host environments after RB lysis. Clearly, both CT376 and CT557 are exposed to human immune cells during chlamydial infection in humans since humans developed robust antibody responses to these proteins. The question is whether CT376 and CT557 can be as inflammatory as HSP60 and immune responses to these proteins can contribute to chlamydial pathogenesis. CT443 or OmcB is an immunodominant protein in the outer membrane complex known as outer membrane complex protein B, although its precise location in chlamydial organisms remains unclear. It has been shown that a CT443 C-terminal fragment is released into host cell cytosol (22), which may explain the high immunogenicity of CT443 C-terminus since chlamydial proteins secreted into or exposed to host cell cytosol are known to be more immunogenic (32-33). Consistent with this concept is the current finding that most human antibodies recognized CT443 fragments covering the C-terminal regions and a previous report that a CD8+ T cell epitope was mapped to CT443 C-terminus (34).

REFERENCES FOR EXAMPLE 2

1. Centers for Disease Control and Prevention C. Sexually Transmitted Disease Surveillance, 2008. In: *Services USDoHaH*, editor. Atlanta, Ga.: www.cdc.gov/std/stats08/toc; November 2009.
2. Centers for Disease Control and Prevention C. Sexually transmitted disease surveillance 2008 supplement, *Chlamydia* Prevalence Monitoring Project Annual Report 2007. In: *U.S. Department of Health and Human Services CfDCaP*, editor. Atlanta, Ga.: U.S. Department of Health and Human Services, Centers for Disease Control and Prevention; January 2009.
3. Rodgers et al. Association of tubal factor infertility with elevated antibodies to *Chlamydia trachomatis* caseinolytic protease P. *Am J Obstet Gynecol* 2010 November; 203(5): 494 e7-e14.
4. Claman et al. The presence of serum antibody to the chlamydial heat shock protein (CHSP60) as a diagnostic test for tubal factor infertility. *Fertil Steril* 1997 March; 67(3):501-4.
5. Rodgers et al. Genome-wide identification of *Chlamydia trachomatis* antigens associated with tubal factor infertility. *Fertil Steril* 2011 September; 96(3):715-21.
6. den Hartog et al. *Chlamydia trachomatis*-associated tubal factor subfertility: Immunogenetic aspects and serological screening. *Hum Reprod Update* 2006 November-December; 12(6):719-30.
7. Stephens et al. Antichlamydial antibodies, human fertility, and pregnancy wastage. *Infect Dis Obstet Gynecol* 2011; 2011:525182.
8. Veenemans and van der Linden. The value of *Chlamydia trachomatis* antibody testing in predicting tubal factor infertility. *Hum Reprod* 2002 March; 17(3):695-8.
9. Peeling et al. Antibody to chlamydial hsp60 predicts an increased risk for chlamydial pelvic inflammatory disease. *J Infect Dis* 1997 May; 175(5): 1153-8.
10. Bax et al. Comparison of serological assays for detection of *Chlamydia trachomatis* antibodies in different groups of obstetrical and gynecological patients. *Clin Diagn Lab Immunol* 2003 January; 10(1):174-6.
11. Wang et al. A Genome-Wide Profiling of the Humoral Immune Response to *Chlamydia trachomatis* Infection Reveals Vaccine Candidate Antigens Expressed in Humans. *J Immunol* 2010 Aug. 1; 185(3):1670-80.
12. Sharma et al. Profiling of human antibody responses to *Chlamydia trachomatis* urogenital tract infection using microplates arrayed with 156 chlamydial fusion proteins. *Infect Immun* 2006 March; 74(3):1490-9.
13. Greene et al. *Chlamydia*-infected cells continue to undergo mitosis and resist induction of apoptosis. *Infect Immun* 2004 January; 72(1):451-60.
14. Zhong et al. Identification of a chlamydial protease-like activity factor responsible for the degradation of host transcription factors. *J Exp Med* 2001 Apr. 16; 193(8):935-42.
15. Greene and Zhong. Inhibition of host cell cytokinesis by *Chlamydia trachomatis* infection. *J Infect* 2003 July; 47(1):45-51.
16. Fan et al. *Chlamydia pneumoniae* secretion of a protease-like activity factor for degrading host cell transcription factors required for [correction of factors is required for] major histocompatibility complex antigen expression. *Infect Immun* 2002 January; 70(1):345-9.
17. Fan et al. Inhibition of apoptosis in chlamydia-infected cells: blockade of mitochondrial cytochrome c release and caspase activation. *J Exp Med* 1998 Feb. 16; 187(4):487-96.
18. Koh et al. Seroprevalence of IgG antibodies against *Chlamydia pneumoniae* in Chinese, Malays and Asian Indians in Singapore. *Int J Epidemiol* 2002 October; 31(5): 1001-7.
19. Ridker et al. Prospective study of *Chlamydia pneumoniae* IgG seropositivity and risks of future myocardial infarction. *Circulation* 1999 Mar. 9; 99(9):1161-4.
20. Li et al. The chlamydial plasmid-encoded protein pgp3 is secreted into the cytosol of *Chlamydia*-infected cells. *Infect Immun* 2008 August; 76(8):3415-28.
21. Chen et al. Characterization of Pgp3, a *Chlamydia trachomatis* plasmid-encoded immunodominant antigen. *J Bacteriol* 2010 Sep. 17.
22. Qi et al. A *Chlamydia trachomatis* OmcB C-terminal fragment is released into host cell cytoplasm and is immunogenic in humans. *Infect Immun* 2011 Mar. 21.
23. Chen et al. The hypothetical protein CT813 is localized in the *Chlamydia trachomatis* inclusion membrane and is immunogenic in women urogenitally infected with *C. trachomatis*. *Infect Immun* 2006 August; 74(8):4826-40.
24. Fling et al. CD8+ T *cells recognize an inclusion membrane-associated protein from the vacuolar pathogen Chlamydia trachomatis*. *Proc Natl Acad Sci USA* 2001 Jan. 30; 98(3):1160-5.
25. Hower et al. Evidence that CT694 is a novel *Chlamydia trachomatis* T3 S substrate capable of functioning during invasion or early cycle development. *Mol Microbiol* 2009 June; 72(6):1423-37.
26. Cappello et al. *Chlamydia trachomatis* infection and anti-Hsp60 immunity: the two sides of the coin. *PLoS Pathog* 2009 August; 5(8):e1000552.

27. Domeika et al. Humoral immune response to conserved epitopes of *Chlamydia trachomatis* and human 60-kDa heat-shock protein in women with pelvic inflammatory disease. *J Infect Dis* 1998 March; 177(3):714-9.
28. Ausiello et al. 60-kDa heat shock protein of *Chlamydia pneumoniae* is a target of T-cell immune response. *J Biol Regul Homeost Agents* 2005 July-December; 19(3-4):136-40.
29. Kinnunen et al. Heat shock protein 60 specific T-cell response in chlamydial infections. *Scand J Immunol* 2001 July-August; 54(1-2):76-81.
30. Hjelholt et al. Tubal factor infertility is associated with antibodies against *Chlamydia trachomatis* heat shock protein 60 (HSP60) but not human HSP60. *Hum Reprod* 2011 August; 26(8):2069-76.
31. Bulut Y et al. Chlamydial heat shock protein 60 activates macrophages and endothelial cells through Toll-like receptor 4 and MD2 in a MyD88-dependent pathway. *J Immunol* 2002 Feb. 1; 168(3):1435-40.
32. Sharma et al. Human antibody responses to a *Chlamydia*-secreted protease factor. *Infect Immun* 2004 December; 72(12):7164-71.
33. Li et al. Characterization of fifty putative inclusion membrane proteins encoded in the *Chlamydia trachomatis* genome. *Infect Immun* 2008 June; 76(6):2746-57.
34. Gervassi et al. Human CD8+ T cells recognize the 60-kDa cysteine-rich outer membrane protein from *Chlamydia trachomatis*. *J Immunol* 2004 Dec. 1; 173(11):6905-13.

TABLE 1

Titers of antibodies against *C. trachomatis* and *C. pneumoniae* in infertile women with or without tubal pathology

| | | Antibodies to *C. trachomatis* | | Antibodies to *C. pneumoniae* | |
|---|---|---|---|---|---|
| | | TFI (n = 31) | IFC (n = 23) | TFI (n = 31) | IFC (n = 23) |
| Quantitative analyses | Mean | 69928 | 3814 | 41503 | 25861 |
| | Standard Deviation | 106709 | 8270 | 65848 | 35847 |
| | Student's t Test | $p = 0.0009$ | | $p = 0.269$ | |
| Categorization of serum samples into Negative, Low and High titer groups | | | | | |
| Qualitative analyses | Negative titers (<1:10) | 1 (3.2%) | 3 (13.0%) | 3 (9.7%) | 4 (17.4%) |
| | Low titers (1:10-1:10000) | 11 (35.5%) | 19 (82.6%) | 11 (34.5%) | 6 (26.1%) |
| | High titers (>1:10000) | 19 (61.3%) | 1 (4.4%) | 17 (54.8%) | 13 (56.5%) |
| | $\chi^2$ Test | $p < 0.001$ | | $p = 0.634$ | |
| | Pairwise $\chi^2$ Tests | High vs. Negative | $p = 0.008$ | N/A | |
| | | High vs. Low | $p < 0.001$ | | |
| | | Low vs. Negative | $p = 0.556$ | | |

TABLE 2

Reactivity of 30 significant *C. trachomatis* proteins with 31 TFI and 23 IFC patient antisera (1:800 dilution)

| CT ORF | TFI (n = 31) X +/− SD | IFC (n = 23) X +/− SD | t-Test | Specificity | Sensitivity | PPV | NPV |
|---|---|---|---|---|---|---|---|
| CT067 | 0.407 ± 0.483 | 0.045 ± 0.115 | <0.001 | 87.0% | 51.6% | 84.2% | 57.1% |
| CT089 | 0.645 ± 0.936 | 0.189 ± 0.407 | 0.020 | 78.3% | 45.2% | 73.7% | 51.4% |
| CT110 | 0.679 ± 0.756 | 0.069 ± 0.112 | <0.001 | 82.6% | 71.0% | 84.6% | 67.9% |
| CT116 | 0.176 ± 0.252 | 0.012 ± 0.059 | 0.001 | 95.7% | 32.3% | 90.9% | 51.2% |
| CT119 | 0.375 ± 0.501 | 0.082 ± 0.196 | 0.005 | 87.0% | 48.4% | 83.3% | 55.6% |
| CT142 | 0.468 ± 0.522 | 0.098 ± 0.138 | 0.001 | 78.3% | 54.8% | 77.3% | 56.3% |
| CT143 | 1.012 ± 0.818 | 0.166 ± 0.220 | <0.001 | 73.9% | 71.0% | 78.6% | 65.4% |
| CT147 | 0.789 ± 0.678 | 0.303 ± 0.185 | 0.001 | 34.8% | 80.6% | 62.5% | 57.1% |
| CT153 | 0.404 ± 0.561 | 0.071 ± 0.110 | 0.003 | 91.3% | 45.2% | 87.5% | 55.3% |
| CT322 | 0.366 ± 0.586 | 0.055 ± 0.112 | 0.007 | 95.7% | 41.9% | 92.9% | 55.0% |
| CT376 | 0.453 ± 0.616 | 0.072 ± 0.097 | 0.002 | 95.7% | 41.9% | 92.9% | 55.0% |
| CT381 | 0.330 ± 0.346 | 0.059 ± 0.074 | <0.001 | 95.7% | 51.6% | 94.1% | 59.5% |
| CT414 | 0.327 ± 0.469 | 0.061 ± 0.082 | 0.004 | 95.7% | 51.6% | 94.1% | 59.5% |
| CT442 | 0.486 ± 0.622 | 0.055 ± 0.070 | 0.001 | 91.3% | 48.4% | 88.2% | 56.8% |
| CT443 | 1.145 ± 1.020 | 0.110 ± 0.173 | <0.001 | 87.0% | 71.0% | 88.0% | 69.0% |
| CT456 | 0.803 ± 0.879 | 0.241 ± 0.558 | 0.006 | 73.9% | 64.5% | 76.9% | 60.7% |
| CT529 | 0.854 ± 0.644 | 0.444 ± 0.310 | 0.003 | 13.0% | 87.1% | 57.4% | 42.9% |
| CT557 | 0.358 ± 0.638 | 0.028 ± 0.057 | 0.007 | 100% | 29.0% | 100% | 51.1% |
| CT603 | 0.579 ± 0.654 | 0.141 ± 0.161 | 0.001 | 78.3% | 61.3% | 79.2% | 60.0% |
| CT681 | 0.363 ± 0.386 | 0.060 ± 0.078 | <0.001 | 87.0% | 51.6% | 84.2% | 57.1% |
| CT694 | 0.698 ± 0.848 | 0.150 ± 0.293 | 0.002 | 78.3% | 54.8% | 77.3% | 56.3% |

TABLE 2-continued

Reactivity of 30 significant *C. trachomatis* proteins with 31 TFI and 23 IFC patient antisera (1:800 dilution)

| CT ORF | TFI (n = 31) X +/− SD | IFC (n = 23) X +/− SD | t-Test | Specificity | Sensitivity | PPV | NPV |
|---|---|---|---|---|---|---|---|
| CT795 | 0.647 ± 0.771 | 0.034 ± 0.101 | <0.001 | 95.7% | 61.3% | 95.0% | 64.7% |
| CT798 | 0.622 ± 0.827 | 0.038 ± 0.089 | <0.001 | 91.3% | 51.6% | 88.9% | 58.3% |
| CT806 | 0.673 ± 0.772 | 0.104 ± 0.212 | <0.001 | 82.6% | 54.8% | 81.0% | 57.6% |
| CT812 | 0.555 ± 0.667 | 0.061 ± 0.087 | <0.001 | 91.3% | 54.8% | 89.5% | 60.0% |
| CT813 | 0.673 ± 0.689 | 0.095 ± 0.165 | <0.001 | 78.3% | 67.7% | 80.8% | 64.3% |
| CT823 | 0.649 ± 0.709 | 0.071 ± 0.074 | <0.001 | 91.3% | 71.0% | 91.7% | 70.0% |
| CT858 | 1.947 ± 1.276 | 0.338 ± 0.666 | <0.001 | 78.3% | 74.2% | 82.1% | 69.2% |
| CT866 | 0.574 ± 0.738 | 0.062 ± 0.079 | 0.001 | 91.3% | 48.4% | 88.2% | 56.8% |
| pCT03 | 1.761 ± 1.366 | 0.166 ± 0.573 | <0.001 | 82.6% | 74.2% | 85.2% | 70.4% |

TABLE 3

Titers of antibodies against *C. trachomatis* and *C. pneumoniae* in women with tubal factor infertility (TFI), normal fertility (FC) or acute infection (STI)

| | Antibodies to *C. trachomatis* | | | Antibodies to *C. pneumoniae* | | |
|---|---|---|---|---|---|---|
| Groups | TFI (n = 24) | FC (n = 25) | STI (n = 24) | TFI (n = 24) | FC (n = 25) | STI (n = 24) |
| Mean | 35483.33 | 23760.00 | 65500.00 | 23000.00 | 17136.00 | 7875.00 |
| Standard deviation | 39950.49 | 23974.43 | 70078.87 | 23083.97 | 19709.45 | 6295.70 |
| ANOVA | | PP = 0.0108 | | | PP = 0.0166 | |
| | TFI vs FC | FC vs. STI | TFI vs. STI | TFI vs FC | FC vs STI | TFI vs. STI |
| Student's t-Test | P = 0.2229 | P = 0.0099 | P = 0.0748 | P = 0.3431 | PP = 0.0331 | P = 0.0033 |

TABLE 4

Antigens preferentially recognized by woman with Tubal Factor Infertility but not normal fertility

| Groups | TFI (N = 24) | | FC (N = 25) | | P value | |
|---|---|---|---|---|---|---|
| ORFs | Freq. | Mean ± SD | Freq. | Mean ± SD | Fisher's | t-Test |
| CT110 | 38% | 0.308 ± 0.512 | 0% | 0.018 ± 0.054 | <0.001 | 0.011 |
| CT376 | 25% | 0.137 ± 0.186 | 0% | 0.005 ± 0.037 | 0.010 | 0.001 |
| CT111 | 17% | 0.129 ± 0.238 | 0% | 0.043 ± 0.062 | 0.050 | 0.098 |
| CT557 | 17% | 0.142 ± 0.289 | 0% | 0.008 ± 0.047 | 0.050 | 0.035 |
| CT579 | 17% | 0.077 ± 0.163 | 0% | 0.004 ± 0.040 | 0.050 | 0.025 |
| CT443 | 88% | 0.717 ± 0.576 | 60% | 0.306 ± 0.258 | 0.030 | 0.003 |
| CT798 | 58% | 0.374 ± 0.403 | 28% | 0.182 ± 0.328 | 0.031 | 0.074 |
| CT603 | 42% | 0.187 ± 0.203 | 16% | 0.071 ± 0.140 | 0.047 | 0.025 |
| CT381 | 21% | 0.102 ± 0.149 | 4% | 0.027 ± 0.072 | 0.086 | 0.031 |
| CT823 | 17% | 0.122 ± 0.158 | 4% | 0.034 ± 0.109 | 0.162 | 0.029 |

TABLE 5

21 antigens most significantly recognized by women with acute *C. trachomatis* infection (antiserum dilution 1:1.000)

| Groups | STI (n = 24) | | TFI (n = 24) | | FC (n = 25) | | STI vs. TFI | | STI vs. FC | | TFI vs. FC | |
|---|---|---|---|---|---|---|---|---|---|---|---|---|
| ORFs | Freq | Mean ± SD | Freq | Mean ± SD | Freq | Mean ± SD | t-Test | Fisher's | t-Test | Fisher's | t-Test | Fisher's |
| CT147 | 88% | 0.937 ± 0.776 | 21% | 0.161 ± 0.191 | 16% | 0.117 ± 0.213 | <0.001 | <0.001 | <0.001 | <0.001 | 0.455 | 0.661 |
| CT442 | 83% | 0.841 ± 0.701 | 17% | 0.151 ± 0.303 | 20% | 0.113 ± 0.229 | <0.001 | <0.001 | <0.001 | <0.001 | 0.623 | 0.763 |
| CT529 | 100% | 1.040 ± 0.620 | 42% | 0.293 ± 0.310 | 32% | 0.227 ± 0.341 | <0.001 | <0.001 | <0.001 | <0.001 | 0.483 | 0.482 |
| CT119 | 75% | 0.603 ± 0.681 | 13% | 0.124 ± 0.212 | 4% | 0.040 ± 0.072 | 0.002 | <0.001 | <0.001 | <0.001 | 0.077 | 0.277 |
| CT089 | 92% | 1.364 ± 0.995 | 33% | 0.274 ± 0.456 | 28% | 0.208 ± 0.388 | <0.001 | <0.001 | <0.001 | <0.001 | 0.586 | 0.685 |
| CT695 | 92% | 0.825 ± 0.731 | 33% | 0.274 ± 0.342 | 24% | 0.144 ± 0.149 | 0.002 | <0.001 | <0.001 | <0.001 | 0.098 | 0.469 |
| CT806 | 88% | 0.739 ± 0.643 | 29% | 0.152 ± 0.231 | 20% | 0.102 ± 0.152 | <0.001 | <0.001 | <0.001 | <0.001 | 0.387 | 0.455 |
| CT875 | 75% | 0.956 ± 0.727 | 17% | 0.145 ± 0.269 | 16% | 0.098 ± 0.170 | <0.001 | <0.001 | <0.001 | <0.001 | 0.472 | 0.949 |
| CT841 | 96% | 1.093 ± 0.625 | 42% | 0.282 ± 0.468 | 48% | 0.232 ± 0.255 | <0.001 | <0.001 | <0.001 | <0.001 | 0.643 | 0.655 |
| CT694 | 92% | 1.235 ± 0.763 | 38% | 0.261 ± 0.375 | 32% | 0.311 ± 0.505 | <0.001 | <0.001 | <0.001 | <0.001 | 0.695 | 0.685 |

TABLE 5-continued 21 antigens most significantly recognized by women with acute *C. trachomatis* infection
(antiserum dilution 1:1.000)

| Groups | STI (n = 24) | | TFI (n = 24) | | FC (n = 25) | | STI vs. TFI | | STI vs. FC | | TFI vs. FC | |
|---|---|---|---|---|---|---|---|---|---|---|---|---|
| ORFs | Freq | Mean ± SD | Freq | Mean ± SD | Freq | Mean ± SD | t-Test | Fisher's | t-Test | Fisher's | t-Test | Fisher's |
| CT480 | 54% | 0.447 ± 0.529 | 4% | 0.046 ± 0.143 | 8% | 0.027 ± 0.101 | <0.001 | <0.001 | <0.001 | <0.001 | 0.594 | 0.575 |
| CT812 | 63% | 0.654 ± 0.731 | 13% | 0.137 ± 0.286 | 4% | 0.028 ± 0.075 | 0.002 | <0.001 | <0.001 | <0.001 | 0.083 | 0.277 |
| CT228 | 50% | 0.377 ± 0.675 | 4% | 0.037 ± 0.063 | 0% | 0.009 ± 0.041 | 0.018 | <0.001 | 0.013 | <0.001 | 0.078 | 0.302 |
| CT153 | 83% | 0.765 ± 0.785 | 33% | 0.238 ± 0.312 | 16% | 0.112 ± 0.134 | 0.004 | <0.001 | <0.001 | <0.001 | 0.079 | 0.158 |
| CT381 | 71% | 0.537 ± 0.579 | 21% | 0.102 ± 0.148 | 4% | 0.026 ± 0.071 | <0.001 | <0.001 | <0.001 | <0.001 | 0.031 | 0.072 |
| CT118 | 46% | 0.298 ± 0.494 | 4% | 0.041 ± 0.077 | 0% | 0.018 ± 0.046 | 0.016 | <0.001 | 0.011 | <0.001 | 0.216 | 0.302 |
| CT149 | 67% | 0.594 ± 0.941 | 21% | 0.136 ± 0.285 | 12% | 0.067 ± 0.192 | 0.027 | 0.001 | 0.012 | <0.001 | 0.331 | 0.402 |
| CT142 | 92% | 1.173 ± 0.686 | 50% | 0.265 ± 0.310 | 28% | 0.204 ± 0.337 | <0.001 | 0.001 | <0.001 | <0.001 | 0.512 | 0.114 |
| CT619 | 33% | 0.184 ± 0.428 | 0% | 0.005 ± 0.035 | 4% | 0.003 ± 0.054 | 0.047 | 0.002 | 0.050 | 0.008 | 0.866 | 0.322 |
| CT702 | 33% | 0.279 ± 0.649 | 0% | 0.017 ± 0.038 | 4% | 0.015 ± 0.067 | 0.030 | 0.002 | 0.037 | 0.008 | 0.875 | 0.322 |
| CT143 | 100% | 1.324 ± 0.681 | 67% | 0.355 ± 0.317 | 40% | 0.202 ± 0.219 | <0.001 | 0.002 | <0.001 | <0.001 | 0.058 | 0.060 |

TABLE 6

5-mer CT443 (OmcB or CRP60, 553 amino acids), ACCESSION#: NP219955.1, GI: 15605169 (SEQ ID NOS: 1-549)

| | |
|---|---|
| 1. | MRIGD |
| 2. | RIGDP |
| 3. | IGDPM |
| 4. | GDPMN |
| 5. | DPMNK |
| 6. | PMNKL |
| 7. | MNKLI |
| 8. | NKLIR |
| 9. | KLIRR |
| 10. | LIRRA |
| 11. | IRRAV |
| 12. | RRAVT |
| 13. | RAVTI |
| 14. | AVTIF |
| 15. | VTIFA |
| 16. | TIFAV |
| 17. | IFAVT |
| 18. | FAVTS |
| 19. | AVTSV |
| 20. | VTSVA |
| 21. | TSVAS |
| 22. | SVASL |
| 23. | VASLF |
| 24. | ASLFA |
| 25. | SLFAS |
| 26. | LFASG |
| 27. | FASGV |
| 28. | ASGVL |
| 29. | SGVLE |
| 30. | GVLET |
| 31. | VLETS |
| 32. | LETSM |
| 33. | ETSMA |
| 34. | TSMAE |
| 35. | SMAES |
| 36. | MAESL |
| 37. | AESLS |
| 38. | ESLST |
| 39. | SLSTN |
| 40. | YATVG |
| 41. | STNVI |
| 42. | TNVIS |
| 43. | NVISL |
| 44. | VISLA |
| 45. | ISLAD |
| 46. | SLADT |
| 47. | LADTK |
| 48. | ADTKA |
| 49. | DTKAK |
| 50. | TKAKD |
| 51. | KAKDN |
| 52. | AKDNT |
| 53. | KDNTS |
| 54. | DNTSH |
| 55. | NTSHK |
| 56. | TSHKS |
| 57. | SHKSK |
| 58. | HKSKK |
| 59. | KSKKA |
| 60. | SKKAR |
| 61. | KKARK |
| 62. | KARKN |
| 63. | ARKNH |
| 64. | RKNHS |
| 65. | KNHSK |
| 66. | NHSKE |
| 67. | HSKET |
| 68. | SKETP |
| 69. | KETPV |
| 70. | ETPVD |
| 71. | TPVDR |
| 72. | PVDRK |
| 73. | VDRKE |
| 74. | DRKEV |
| 75. | RKEVA |
| 76. | KEVAP |
| 77. | EVAPV |
| 78. | VAPVH |
| 79. | APVHE |
| 80. | PVHES |
| 81. | TTPTA |
| 82. | HESKA |
| 83. | ESKAT |
| 84. | SKATG |
| 85. | KATGP |
| 86. | ATGPK |
| 87. | TGPKQ |
| 88. | GPKQD |
| 89. | PKQDS |
| 90. | KQDSC |
| 91. | QDSCF |
| 92. | DSCFG |
| 93. | SCFGR |
| 94. | CFGRM |
| 95. | FGRMY |
| 96. | GRMYT |
| 97. | RMYTV |
| 98. | MYTVK |
| 99. | YTVKV |
| 100. | TVKVN |
| 101. | VKVND |
| 102. | KVNDD |
| 103. | VNDDR |
| 104. | NDDRN |
| 105. | DDRNV |
| 106. | DRNVE |
| 107. | RNVEI |
| 108. | NVEIT |

TABLE 6-continued

| | |
|---|---|
| 109. | VEITQ |
| 110. | EITQA |
| 111. | ITQAV |
| 112. | TQAVP |
| 113. | QAVPE |
| 114. | AVPEY |
| 115. | VPEYA |
| 116. | PEYAT |
| 117. | EYATV |
| 118. | YATVG |
| 119. | ATVGS |
| 120. | TVGSP |
| 121. | VGSPY |
| 122. | GSPYP |
| 123. | SPYPI |
| 124. | PYPIE |
| 125. | YPIEI |
| 126. | PIEIT |
| 127. | IEITA |
| 128. | EITAT |
| 129. | ITATG |
| 130. | TATGK |
| 131. | ATGKR |
| 132. | TGKRD |
| 133. | GKRDC |
| 134. | KRDCV |
| 135. | RDCVD |
| 136. | DCVDV |
| 137. | CVDVI |
| 138. | VDVII |
| 139. | DVIIT |
| 140. | VIITQ |
| 141. | IITQQ |
| 142. | ITQQL |
| 143. | TQQLP |
| 144. | QQLPC |
| 145. | QLPCE |
| 146. | LPCEA |
| 147. | PCEAE |
| 148. | CEAEF |
| 149. | EAEFV |
| 150. | AEFVR |
| 151. | EFVRS |
| 152. | FVRSD |
| 153. | VRSDP |
| 154. | RSDPA |
| 155. | SDPAT |
| 156. | DPATT |
| 157. | PATTP |
| 158. | ATTPT |
| 159. | TTPTA |
| 160. | TPTAD |
| 161. | PTADG |
| 162. | TADGK |
| 163. | ADGKL |
| 164. | DGKLV |
| 165. | GKLVW |
| 166. | KLVWK |
| 167. | LVWKI |
| 168. | VWKID |
| 169. | WKIDR |
| 170. | KIDRL |
| 171. | IDRLG |
| 172. | DRLGQ |
| 173. | RLGQG |
| 174. | LGQGE |
| 175. | GQGEK |
| 176. | QGEKS |
| 177. | GEKSK |
| 178. | EKSKI |
| 179. | KSKIT |
| 180. | SKITV |
| 181. | KITVW |
| 182. | ITVWV |
| 183. | TVWVK |
| 184. | VWVKP |
| 185. | WVKPL |
| 186. | VKPLK |
| 187. | KPLKE |
| 188. | PLKEG |

TABLE 6-continued

| | |
|---|---|
| 189. | LKEGC |
| 190. | KEGCC |
| 191. | EGCCF |
| 192. | GCCFT |
| 193. | CCFTA |
| 194. | CFTAA |
| 195. | FTAAT |
| 196. | TAATV |
| 197. | AATVC |
| 198. | ATVCA |
| 199. | TVCAC |
| 200. | VCACP |
| 201. | CACPE |
| 202. | ACPEI |
| 203. | CPEIR |
| 204. | PEIRS |
| 205. | EIRSV |
| 206. | IRSVT |
| 207. | RSVTK |
| 208. | SVTKC |
| 209. | VTKCG |
| 210. | TKCGQ |
| 211. | KCGQP |
| 212. | CGQPA |
| 213. | GQPAI |
| 214. | QPAIC |
| 215. | PAICV |
| 216. | AICVK |
| 217. | ICVKQ |
| 218. | CVKQE |
| 219. | VKQEG |
| 220. | KQEGP |
| 221. | QEGPE |
| 222. | EGPEN |
| 223. | GPENA |
| 224. | PENAC |
| 225. | ENACL |
| 226. | NACLR |
| 227. | ACLRC |
| 228. | CLRCP |
| 229. | LRCPV |
| 230. | RCPVV |
| 231. | CPVVY |
| 232. | PVVYK |
| 233. | VVYKI |
| 234. | VYKIN |
| 235. | YKINI |
| 236. | KINIV |
| 237. | INIVN |
| 238. | NIVNQ |
| 239. | IVNQG |
| 240. | VNQGT |
| 241. | NQGTA |
| 242. | QGTAT |
| 243. | GTATA |
| 244. | TATAR |
| 245. | ATARN |
| 246. | TARNV |
| 247. | ARNVV |
| 248. | RNVVV |
| 249. | NVVVE |
| 250. | VVVEN |
| 251. | VVENP |
| 252. | VENPV |
| 253. | ENPVP |
| 254. | NPVPD |
| 255. | PVPDG |
| 256. | VPDGY |
| 257. | PDGYA |
| 258. | DGYAH |
| 259. | GYAHS |
| 260. | YAHSS |
| 261. | AHSSG |
| 262. | HSSGQ |
| 263. | SSGQR |
| 264. | SGQRV |
| 265. | GQRVL |
| 266. | QRVLT |
| 267. | RVLTF |
| 268. | VLTFT |

TABLE 6-continued

| | |
|---|---|
| 269. | LTFTL |
| 270. | TFTLG |
| 271. | FTLGD |
| 272. | TLGDM |
| 273. | LGDMQ |
| 274. | GDMQP |
| 275. | DMQPG |
| 276. | MQPGE |
| 277. | QPGEH |
| 278. | PGEHR |
| 279. | GEHRT |
| 280. | EHRTI |
| 281. | HRTIT |
| 282. | RTITV |
| 283. | TITVE |
| 284. | ITVEF |
| 285. | TVEFC |
| 286. | VEFCP |
| 287. | EFCPL |
| 288. | FCPLK |
| 289. | CPLKR |
| 290. | PLKRG |
| 291. | LKRGR |
| 292. | KRGRA |
| 293. | RGRAT |
| 294. | GRATN |
| 295. | RATNI |
| 296. | ATNIA |
| 297. | TNIAT |
| 298. | NIATV |
| 299. | IATVS |
| 300. | ATVSY |
| 301. | TVSYC |
| 302. | VSYCG |
| 303. | SYCGG |
| 304. | YCGGH |
| 305. | CGGHK |
| 306. | GGHKN |
| 307. | GHKNT |
| 308. | HKNTA |
| 309. | KNTAS |
| 310. | NTASV |
| 311. | TASVT |
| 312. | ASVTT |
| 313. | SVTTV |
| 314. | VTTVI |
| 315. | TTVIN |
| 316. | TVINE |
| 317. | VINEP |
| 318. | INEPC |
| 319. | NEPCV |
| 320. | EPCVQ |
| 321. | PCVQV |
| 322. | CVQVS |
| 323. | VQVSI |
| 324. | QVSIA |
| 325. | VSIAG |
| 326. | SIAGA |
| 327. | IAGAD |
| 328. | AGADW |
| 329. | GADWS |
| 330. | ADWSY |
| 331. | DWSYV |
| 332. | WSYVC |
| 333. | SYVCK |
| 334. | YVCKP |
| 335. | VCKPV |
| 336. | CKPVE |
| 337. | KPVEY |
| 338. | PVEYV |
| 339. | VEYVI |
| 340. | EYVIS |
| 341. | YVISV |
| 342. | VISVS |
| 343. | ISVSN |
| 344. | SVSNP |
| 345. | VSNPG |
| 346. | SNPGD |
| 347. | NPGDL |
| 348. | PGDLV |
| 349. | GDLVL |
| 350. | DLVLR |
| 351. | LVLRD |
| 352. | VLRDV |
| 353. | LRDVV |
| 354. | RDVVV |
| 355. | DVVVE |
| 356. | VVVED |
| 357. | VVEDT |
| 358. | VEDTL |
| 359. | EDTLS |
| 360. | DTLSP |
| 361. | TLSPG |
| 362. | LSPGV |
| 363. | SPGVT |
| 364. | PGVTV |
| 365. | GVTVL |
| 366. | VTVLE |
| 367. | TVLEA |
| 368. | VLEAA |
| 369. | LEAAG |
| 370. | EAAGA |
| 371. | AAGAQ |
| 372. | AGAQI |
| 373. | GAQIS |
| 374. | AQISC |
| 375. | QISCN |
| 376. | ISCNK |
| 377. | SCNKV |
| 378. | CNKVV |
| 379. | NKVVW |
| 380. | KVVWT |
| 381. | VVWTV |
| 382. | VWTVK |
| 383. | WTVKE |
| 384. | TVKEL |
| 385. | VKELN |
| 386. | KELNP |
| 387. | ELNPG |
| 388. | LNPGE |
| 389. | NPGES |
| 390. | PGESL |
| 391. | GESLQ |
| 392. | ESLQY |
| 393. | SLQYK |
| 394. | LQYKV |
| 395. | QYKVL |
| 396. | YKVLV |
| 397. | KVLVR |
| 398. | VLVRA |
| 399. | LVRAQ |
| 400. | VRAQT |
| 401. | RAQTP |
| 402. | AQTPG |
| 403. | QTPGQ |
| 404. | TPGQF |
| 405. | PGQFT |
| 406. | GQFTN |
| 407. | QFTNN |
| 408. | FTNNV |
| 409. | TNNVV |
| 410. | NNVVV |
| 411. | NVVVK |
| 412. | VVVKS |
| 413. | VVKSC |
| 414. | VKSCS |
| 415. | KSCSD |
| 416. | SCSDC |
| 417. | CSDCG |
| 418. | SDCGT |
| 419. | DCGTC |
| 420. | CGTCT |
| 421. | GTCTS |
| 422. | TCTSC |
| 423. | CTSCA |
| 424. | TSCAE |
| 425. | SCAEA |
| 426. | CAEAT |
| 427. | AEATT |
| 428. | EATTY |

TABLE 6-continued

| | |
|---|---|
| 429. | ATTYW |
| 430. | TTYWK |
| 431. | TYWKG |
| 432. | YWKGV |
| 433. | WKGVA |
| 434. | KGVAA |
| 435. | GVAAT |
| 436. | VAATH |
| 437. | AATHM |
| 438. | ATHMC |
| 439. | THMCV |
| 440. | HMCVV |
| 441. | MCVVD |
| 442. | CVVDT |
| 443. | VVDTC |
| 444. | VDTCD |
| 445. | DTCDP |
| 446. | TCDPV |
| 447. | CDPVC |
| 448. | DPVCV |
| 449. | PVCVG |
| 450. | VCVGE |
| 451. | CVGEN |
| 452. | VGENT |
| 453. | GENTV |
| 454. | ENTVY |
| 455. | NTVYR |
| 456. | TVYRI |
| 457. | VYRIC |
| 458. | YRICV |
| 459. | RICVT |
| 460. | ICVTN |
| 461. | CVTNR |
| 462. | VTNRG |
| 463. | TNRGS |
| 464. | NRGSA |
| 465. | RGSAE |
| 466. | GSAED |
| 467. | SAEDT |
| 468. | AEDTN |
| 469. | EDTNV |
| 470. | DTNVS |
| 471. | TNVSL |
| 472. | NVSLM |
| 473. | VSLML |
| 474. | SLMLK |
| 475. | LMLKF |
| 476. | MLKFS |
| 477. | LKFSK |
| 478. | KFSKE |
| 479. | FSKEL |
| 480. | SKELQ |
| 481. | KELQP |
| 482. | ELQPV |
| 483. | LQPVS |
| 484. | QPVSF |
| 485. | PVSFS |
| 486. | VSFSG |
| 487. | SFSGP |
| 488. | FSGPT |
| 489. | SGPTK |
| 490. | GPTKG |
| 491. | PTKGT |
| 492. | TKGTI |
| 493. | KGTIT |
| 494. | GTITG |
| 495. | TITGN |
| 496. | ITGNT |
| 497. | TGNTV |
| 498. | GNTVV |
| 499. | NTVVF |
| 500. | TVVFD |
| 501. | VVFDS |
| 502. | VFDSL |
| 503. | FDSLP |
| 504. | DSLPR |
| 505. | SLPRL |
| 506. | LPRLG |
| 507. | PRLGS |
| 508. | RLGSK |

TABLE 6-continued

| | |
|---|---|
| 509. | LGSKE |
| 510. | GSKET |
| 511. | SKETV |
| 512. | KETVE |
| 513. | ETVEF |
| 514. | TVEFS |
| 515. | VEFSV |
| 516. | EFSVT |
| 517. | FSVTL |
| 518. | SVTLK |
| 519. | VTLKA |
| 520. | TLKAV |
| 521. | LKAVS |
| 522. | KAVSA |
| 523. | AVSAG |
| 524. | VSAGD |
| 525. | SAGDA |
| 526. | AGDAR |
| 527. | GDARG |
| 528. | DARGE |
| 529. | ARGEA |
| 530. | RGEAI |
| 531. | GEAIL |
| 532. | EAILS |
| 533. | AILSS |
| 534. | ILSSD |
| 535. | LSSDT |
| 536. | SSDTL |
| 537. | SDTLT |
| 538. | DTLTV |
| 539. | TLTVP |
| 540. | LTVPV |
| 541. | TVPVS |
| 542. | VPVSD |
| 543. | PVSDT |
| 544. | VSDTE |
| 545. | SDTEN |
| 546. | DTENT |
| 547. | TENTH |
| 548. | ENTHI |
| 549. | NTHIY |

5-mer peptides of CT381 (ArtJ, 257 amino acids), accession#: NP 219890.1, GI: 15605105 (SEQ ID NOS: 550-802)

| | |
|---|---|
| 550. | MCIKR |
| 551. | CIKRK |
| 552. | IKRKK |
| 553. | KRKKT |
| 554. | RKKTW |
| 555. | KKTWI |
| 556. | KTWIA |
| 557. | TWIAF |
| 558. | WIAFL |
| 559. | IAFLA |
| 560. | AFLAV |
| 561. | FLAVV |
| 562. | LAVVC |
| 563. | AVVCS |
| 564. | VVCSF |
| 565. | VCSFC |
| 566. | CSFCL |
| 567. | SFCLT |
| 568. | FCLTG |
| 569. | CLTGC |
| 570. | LTGCL |
| 571. | TGCLK |
| 572. | GCLKE |
| 573. | CLKEG |
| 574. | LKEGG |
| 575. | KEGGD |
| 576. | EGGDS |
| 577. | GGDSN |
| 578. | GDSNS |
| 579. | DSNSE |
| 580. | SNSEK |
| 581. | NSEKF |
| 582. | SEKFI |
| 583. | EKFIV |

TABLE 6-continued

| | |
|---|---|
| 584. | KFIVG |
| 585. | FIVGT |
| 586. | IVGTN |
| 587. | VGTNA |
| 588. | GTNAT |
| 589. | TNATY |
| 590. | NATYP |
| 591. | ATYPP |
| 592. | TYPPF |
| 593. | YPPFE |
| 594. | PPFEF |
| 595. | PFEFV |
| 596. | FEFVD |
| 597. | EFVDK |
| 598. | FVDKR |
| 599. | VDKRG |
| 600. | DKRGE |
| 601. | KRGEV |
| 602. | RGEVV |
| 603. | GEVVG |
| 604. | EVVGF |
| 605. | VVGFD |
| 606. | VGFDI |
| 607. | GFDID |
| 608. | FDIDL |
| 609. | DIDLA |
| 610. | IDLAR |
| 611. | DLARE |
| 612. | LAREI |
| 613. | AREIS |
| 614. | REISN |
| 615. | EISNK |
| 616. | ISNKL |
| 617. | SNKLG |
| 618. | NKLGK |
| 619. | KLGKT |
| 620. | LGKTL |
| 621. | GKTLD |
| 622. | KTLDV |
| 623. | TLDVR |
| 624. | LDVRE |
| 625. | DVREF |
| 626. | VREFS |
| 627. | REFSF |
| 628. | EFSFD |
| 629. | FSFDA |
| 630. | SFDAL |
| 631. | FDALI |
| 632. | DALIL |
| 633. | ALILN |
| 634. | LILNL |
| 635. | ILNLK |
| 636. | LNLKQ |
| 637. | NLKQH |
| 638. | LKQHR |
| 639. | KQHRI |
| 640. | QHRID |
| 641. | HRIDA |
| 642. | RIDAV |
| 643. | IDAVI |
| 644. | DAVIT |
| 645. | AVITG |
| 646. | VITGM |
| 647. | ITGMS |
| 648. | TGMSI |
| 649. | GMSIT |
| 650. | MSITP |
| 651. | SITPS |
| 652. | ITPSR |
| 653. | TPSRL |
| 654. | PSRLK |
| 655. | SRLKE |
| 656. | RLKEI |
| 657. | LKEIL |
| 658. | KEILM |
| 659. | EILMI |
| 660. | ILMIP |
| 661. | LMIPY |
| 662. | MIPYY |
| 663. | IPYYG |

TABLE 6-continued

| | |
|---|---|
| 664. | PYYGE |
| 665. | YYGEE |
| 666. | YGEEI |
| 667. | GEEIK |
| 668. | EEIKH |
| 669. | EIKHL |
| 670. | IKHLV |
| 671. | KHLVL |
| 672. | HLVLV |
| 673. | LVLVF |
| 674. | VLVFK |
| 675. | LVFKG |
| 676. | VFKGE |
| 677. | FKGEN |
| 678. | KGENK |
| 679. | GENKH |
| 680. | ENKHP |
| 681. | NKHPL |
| 682. | KHPLP |
| 683. | HPLPL |
| 684. | PLPLT |
| 685. | LPLTQ |
| 686. | PLTQY |
| 687. | LTQYR |
| 688. | TQYRS |
| 689. | QYRSV |
| 690. | YRSVA |
| 691. | RSVAV |
| 692. | SVAVQ |
| 693. | VAVQT |
| 694. | AVQTG |
| 695. | VQTGT |
| 696. | QTGTY |
| 697. | TGTYQ |
| 698. | GTYQE |
| 699. | TYQEA |
| 700. | YQEAY |
| 701. | QEAYL |
| 702. | EAYLQ |
| 703. | AYLQS |
| 704. | YLQSL |
| 705. | LQSLS |
| 706. | QSLSE |
| 707. | SLSEV |
| 708. | LSEVH |
| 709. | SEVHI |
| 710. | EVHIR |
| 711. | VHIRS |
| 712. | HIRSF |
| 713. | IRSFD |
| 714. | RSFDS |
| 715. | SFDST |
| 716. | FDSTL |
| 717. | DSTLE |
| 718. | STLEV |
| 719. | TLEVL |
| 720. | LEVLM |
| 721. | EVLME |
| 722. | VLMEV |
| 723. | LMEVM |
| 724. | MEVMH |
| 725. | EVMHG |
| 726. | VMHGK |
| 727. | MHGKS |
| 728. | HGKSP |
| 729. | GKSPV |
| 730. | KSPVA |
| 731. | SPVAV |
| 732. | PVAVL |
| 733. | VAVLE |
| 734. | AVLEP |
| 735. | VLEPS |
| 736. | LEPSI |
| 737. | EPSIA |
| 738. | PSIAQ |
| 739. | SIAQV |
| 740. | IAQVV |
| 741. | AQVVL |
| 742. | QVVLK |
| 743. | VVLKD |

TABLE 6-continued

| | |
|---|---|
| 744. | VLKDF |
| 745. | LKDFP |
| 746. | KDFPA |
| 747. | DFPAL |
| 748. | FPALS |
| 749. | PALST |
| 750. | ALSTA |
| 751. | LSTAT |
| 752. | STATI |
| 753. | TATID |
| 754. | ATIDL |
| 755. | TIDLP |
| 756. | IDLPE |
| 757. | DLPED |
| 758. | LPEDQ |
| 759. | PEDQW |
| 760. | EDQWV |
| 761. | DQWVL |
| 762. | QWVLG |
| 763. | WVLGY |
| 764. | VLGYG |
| 765. | LGYGI |
| 766. | GYGIG |
| 767. | YGIGV |
| 768. | GIGVA |
| 769. | IGVAS |
| 770. | GVASD |
| 771. | VASDR |
| 772. | ASDRP |
| 773. | SDRPA |
| 774. | DRPAL |
| 775. | RPALA |
| 776. | PALAL |
| 777. | ALALK |
| 778. | LALKI |
| 779. | ALKIE |
| 780. | LKIEA |
| 781. | KIEAA |
| 782. | IEAAV |
| 783. | EAAVQ |
| 784. | AAVQE |
| 785. | AVQEI |
| 786. | VQEIR |
| 787. | QEIRK |
| 788. | EIRKE |
| 789. | IRKEG |
| 790. | RKEGV |
| 791. | KEGVL |
| 792. | EGVLA |
| 793. | GVLAE |
| 794. | VLAEL |
| 795. | LAELE |
| 796. | AELEQ |
| 797. | ELEQK |
| 798. | LEQKW |
| 799. | EQKWG |
| 800. | QKWGL |
| 801. | KWGLN |
| 802. | WGLNN |

5-mer peptides of CT875 (hypothetical protein, 591 amino acids), ACCESSION#: NP_219502.1, GI: 15604718 (SEQ ID NOS: 803-1389)

| | |
|---|---|
| 803. | MSIRG |
| 804. | SIRGV |
| 805. | IRGVG |
| 806. | RGVGG |
| 807. | GVGGN |
| 808. | VGGNG |
| 809. | GNGNS |
| 810. | NGNSR |
| 811. | GNSRI |
| 812. | NSRIP |
| 813. | SRIPS |
| 814. | RIPSH |
| 815. | IPSHN |
| 816. | PSHNG |
| 817. | SHNGD |
| 818. | HNGDG |

TABLE 6-continued

| | |
|---|---|
| 819. | NGDGS |
| 820. | GDGSN |
| 821. | DGSNR |
| 822. | GSNRR |
| 823. | SNRRS |
| 824. | NRRSQ |
| 825. | RRSQN |
| 826. | RSQNT |
| 827. | SQNTK |
| 828. | QNTKG |
| 829. | NTKGN |
| 830. | TKGNN |
| 831. | KGNNK |
| 832. | GNNKV |
| 833. | NNKVE |
| 834. | NKVED |
| 835. | KVEDR |
| 836. | VEDRV |
| 837. | VEDRV |
| 838. | EDRVC |
| 839. | DRVCS |
| 840. | RVCSL |
| 841. | VCSLY |
| 842. | CSLYS |
| 843. | SLYSS |
| 844. | LYSSR |
| 845. | YSSRS |
| 846. | SSRSN |
| 847. | SRSNE |
| 848. | RSNEN |
| 849. | SNENR |
| 850. | NENRE |
| 851. | ENRES |
| 852. | NRESP |
| 853. | RESPY |
| 854. | ESPYA |
| 855. | SPYAV |
| 856. | PYAVV |
| 857. | YAVVD |
| 858. | AVVDV |
| 859. | VVDVS |
| 860. | VDVSS |
| 861. | DVSSM |
| 862. | VSSMI |
| 863. | SSMIE |
| 864. | SMIES |
| 865. | MIEST |
| 866. | IESTP |
| 867. | ESTPT |
| 868. | STPTS |
| 869. | TPTSG |
| 870. | PTSGE |
| 871. | TSGET |
| 872. | SGETT |
| 873. | GETTR |
| 874. | ETTRA |
| 875. | TTRAS |
| 876. | TRASR |
| 877. | RASRG |
| 878. | ASRGV |
| 879. | SRGVF |
| 880. | RGVFS |
| 881. | GVFSR |
| 882. | VFSRF |
| 883. | FSRFQ |
| 884. | SRFQR |
| 885. | RFQRG |
| 886. | FQRGL |
| 887. | QRGLV |
| 888. | RGLVR |
| 889. | GLVRV |
| 890. | LVRVA |
| 891. | VRVAD |
| 892. | RVADK |
| 893. | VADKV |
| 894. | ADKVR |
| 895. | DKVRR |
| 896. | KVRRA |
| 897. | VRRAV |
| 898. | RRAVQ |

TABLE 6-continued

| | |
|---|---|
| 899. | RAVQC |
| 900. | AVQCA |
| 901. | VQCAW |
| 902. | QCAWS |
| 903. | CAWSS |
| 904. | AWSSV |
| 905. | WSSVS |
| 906. | SSVST |
| 907. | SVSTR |
| 908. | VSTRR |
| 909. | STRRS |
| 910. | TRRSS |
| 911. | RRSSA |
| 912. | RSSAT |
| 913. | SSATR |
| 914. | SATRA |
| 915. | ATRAA |
| 916. | TRAAE |
| 917. | RAAES |
| 918. | AAESG |
| 919. | AESGS |
| 920. | ESGSS |
| 921. | SGSSS |
| 922. | GSSSR |
| 923. | SSSRT |
| 924. | SSRTA |
| 925. | SRTAR |
| 926. | RTARG |
| 927. | TARGA |
| 928. | ARGAS |
| 929. | RGASS |
| 930. | GASSG |
| 931. | ASSGY |
| 932. | SSGYR |
| 933. | SGYRE |
| 934. | GYREY |
| 935. | YREYS |
| 936. | REYSP |
| 937. | EYSPS |
| 938. | YSPSA |
| 939. | SPSAA |
| 940. | PSAAR |
| 941. | SAARG |
| 942. | AARGL |
| 943. | ARGLR |
| 944. | RGLRL |
| 945. | GLRLM |
| 946. | LRLMF |
| 947. | RLMFT |
| 948. | LMFTD |
| 949. | MFTDF |
| 950. | FTDFW |
| 951. | TDFWR |
| 952. | DFWRT |
| 953. | FWRTR |
| 954. | WRTRV |
| 955. | RTRVL |
| 956. | TRVLR |
| 957. | RVLRQ |
| 958. | VLRQT |
| 959. | LRQTS |
| 960. | RQTSP |
| 961. | QTSPM |
| 962. | TSPMA |
| 963. | SPMAG |
| 964. | PMAGV |
| 965. | MAGVF |
| 966. | AGVFG |
| 967. | GVFGN |
| 968. | VFGNL |
| 969. | FGNLD |
| 970. | GNLDV |
| 971. | NLDVN |
| 972. | LDVNE |
| 973. | DVNEA |
| 974. | VNEAR |
| 975. | NEARL |
| 976. | EARLM |
| 977. | ARLMA |
| 978. | RLMAA |
| 979. | LMAAY |
| 980. | MAAYT |
| 981. | AAYTS |
| 982. | AYTSE |
| 983. | YTSEC |
| 984. | TSECA |
| 985. | SECAD |
| 986. | ECADH |
| 987. | CADHL |
| 988. | ADHLE |
| 989. | DHLEA |
| 990. | HLEAN |
| 991. | LEANK |
| 992. | EANKL |
| 993. | ANKLA |
| 994. | NKLAG |
| 995. | KLAGP |
| 996. | LAGPD |
| 997. | AGPDG |
| 998. | GPDGV |
| 999. | PDGVA |
| 1000. | DGVAA |
| 1001. | GVAAA |
| 1002. | VAAAR |
| 1003. | AAARE |
| 1004. | AAREI |
| 1005. | AREIA |
| 1006. | REIAK |
| 1007. | EIAKR |
| 1008. | IAKRW |
| 1009. | AKRWE |
| 1010. | KRWEQ |
| 1011. | RWEQR |
| 1012. | WEQRV |
| 1013. | EQRVR |
| 1014. | QRVRD |
| 1015. | RVRDL |
| 1016. | VRDLQ |
| 1017. | RDLQD |
| 1018. | DLQDK |
| 1019. | LQDKG |
| 1020. | QDKGA |
| 1021. | DKGAA |
| 1022. | KGAAR |
| 1023. | GAARK |
| 1024. | AARKL |
| 1025. | ARKLL |
| 1026. | RKLLN |
| 1027. | KLLND |
| 1028. | LLNDP |
| 1029. | LNDPL |
| 1030. | NDPLG |
| 1031. | DPLGR |
| 1032. | PLGRR |
| 1033. | LGRRT |
| 1034. | GRRTP |
| 1035. | RRTPN |
| 1036. | RTPNY |
| 1037. | TPNYQ |
| 1038. | PNYQS |
| 1039. | NYQSK |
| 1040. | YQSKN |
| 1041. | QSKNP |
| 1042. | SKNPG |
| 1043. | KNPGE |
| 1044. | NPGEY |
| 1045. | PGEYT |
| 1046. | GEYTV |
| 1047. | EYTVG |
| 1048. | YTVGN |
| 1049. | TVGNS |
| 1050. | VGNSM |
| 1051. | GNSMF |
| 1052. | NSMFY |
| 1053. | SMFYD |
| 1054. | MFYDG |
| 1055. | FYDGP |
| 1056. | YDGPQ |
| 1057. | DGPQV |
| 1058. | GPQVA |

TABLE 6-continued

| | |
|---|---|
| 1059. | PQVAN |
| 1060. | QVANL |
| 1061. | VANLQ |
| 1062. | ANLQN |
| 1063. | NLQNV |
| 1064. | LQNVD |
| 1065. | QNVDT |
| 1066. | NVDTG |
| 1067. | VDTGF |
| 1068. | DTGFW |
| 1069. | TGFWL |
| 1070. | GFWLD |
| 1071. | FWLDM |
| 1072. | WLDMS |
| 1073. | LDMSN |
| 1074. | DMSNL |
| 1075. | MSNLS |
| 1076. | SNLSD |
| 1077. | NLSDV |
| 1078. | LSDVV |
| 1079. | SDVVL |
| 1080. | DVVLS |
| 1081. | VVLSR |
| 1082. | VLSRE |
| 1083. | LSREI |
| 1084. | SREIQ |
| 1085. | REIQT |
| 1086. | EIQTG |
| 1087. | IQTGL |
| 1088. | QTGLR |
| 1089. | TGLRA |
| 1090. | GLRAR |
| 1091. | LRARA |
| 1092. | RARAT |
| 1093. | ARATL |
| 1094. | RATLE |
| 1095. | ATLEE |
| 1096. | TLEES |
| 1097. | LEESM |
| 1098. | EESMP |
| 1099. | ESMPM |
| 1100. | SMPML |
| 1101. | MPMLE |
| 1102. | PMLEN |
| 1103. | MLENL |
| 1104. | LENLE |
| 1105. | ENLEE |
| 1106. | NLEER |
| 1107. | LEERF |
| 1108. | EERFR |
| 1109. | ERFRR |
| 1110. | RFRRL |
| 1111. | FRRLQ |
| 1112. | RRLQE |
| 1113. | RLQET |
| 1114. | LQETC |
| 1115. | QETCD |
| 1116. | ETCDA |
| 1117. | TCDAA |
| 1118. | CDAAR |
| 1119. | DAART |
| 1120. | AARTE |
| 1121. | ARTEI |
| 1122. | RTEIE |
| 1123. | TEIEE |
| 1124. | EIEES |
| 1125. | IEESG |
| 1126. | EESGW |
| 1127. | ESGWT |
| 1128. | SGWTR |
| 1129. | GWTRE |
| 1130. | WTRES |
| 1131. | TRESA |
| 1132. | RESAS |
| 1133. | ESASR |
| 1134. | SASRM |
| 1135. | ASRME |
| 1136. | SRMEG |
| 1137. | RMEGD |
| 1138. | MEGDE |
| 1139. | EGDEA |
| 1140. | GDEAQ |
| 1141. | DEAQG |
| 1142. | EAQGP |
| 1143. | AQGPS |
| 1144. | QGPSR |
| 1145. | GPSRA |
| 1146. | PSRAQ |
| 1147. | SRAQQ |
| 1148. | RAQQA |
| 1149. | AQQAF |
| 1150. | QQAFQ |
| 1151. | QAFQS |
| 1152. | AFQSF |
| 1153. | FQSFV |
| 1154. | QSFVN |
| 1155. | SFVNE |
| 1156. | FVNEC |
| 1157. | VNECN |
| 1158. | NECNS |
| 1159. | ECNSI |
| 1160. | CNSIE |
| 1161. | NSIEF |
| 1162. | SIEFS |
| 1163. | IEFSF |
| 1164. | EFSFG |
| 1165. | FSFGS |
| 1166. | SFGSF |
| 1167. | FGSFG |
| 1168. | GSFGE |
| 1169. | SFGEH |
| 1170. | FGEHV |
| 1171. | GEHVR |
| 1172. | EHVRV |
| 1173. | HVRVL |
| 1174. | VRVLC |
| 1175. | RVLCA |
| 1176. | VLCAR |
| 1177. | LCARV |
| 1178. | CARVS |
| 1179. | ARVSR |
| 1180. | RVSRG |
| 1181. | VSRGL |
| 1182. | SRGLA |
| 1183. | RGLAA |
| 1184. | GLAAA |
| 1185. | LAAAG |
| 1186. | AAAGE |
| 1187. | AAGEA |
| 1188. | AGEAI |
| 1189. | GEAIR |
| 1190. | EAIRR |
| 1191. | AIRRC |
| 1192. | IRRCF |
| 1193. | RRCFS |
| 1194. | RCFSC |
| 1195. | CFSCC |
| 1196. | FSCCK |
| 1197. | SCCKG |
| 1198. | CCKGS |
| 1199. | CKGST |
| 1200. | KGSTH |
| 1201. | GSTHR |
| 1202. | STHRY |
| 1203. | THRYA |
| 1204. | HRYAP |
| 1205. | RYAPR |
| 1206. | YAPRD |
| 1207. | APRDD |
| 1208. | PRDDL |
| 1209. | RDDLS |
| 1210. | DDLSP |
| 1211. | DLSPE |
| 1212. | LSPEG |
| 1213. | SPEGA |
| 1214. | PEGAS |
| 1215. | EGASL |
| 1216. | GASLA |
| 1217. | ASLAE |
| 1218. | SLAET |

TABLE 6-continued

| | |
|---|---|
| 1219. | LAETL |
| 1220. | AETLA |
| 1221. | ETLAR |
| 1222. | TLARF |
| 1223. | LARFA |
| 1224. | ARFAD |
| 1225. | RFADD |
| 1226. | FADDM |
| 1227. | ADDMG |
| 1228. | DDMGI |
| 1229. | DMGIE |
| 1230. | MGIER |
| 1231. | GIERG |
| 1232. | IERGA |
| 1233. | ERGAD |
| 1234. | RGADG |
| 1235. | GADGT |
| 1236. | ADGTY |
| 1237. | DGTYD |
| 1238. | GTYDI |
| 1239. | TYDIP |
| 1240. | YDIPL |
| 1241. | DIPLV |
| 1242. | IPLVD |
| 1243. | PLVDD |
| 1244. | LVDDW |
| 1245. | VDDWR |
| 1246. | DDWRR |
| 1247. | DWRRG |
| 1248. | WRRGV |
| 1249. | RRGVP |
| 1250. | RGVPS |
| 1251. | GVPSI |
| 1252. | VPSIE |
| 1253. | PSIEG |
| 1254. | SIEGE |
| 1255. | IEGEG |
| 1256. | EGEGS |
| 1257. | GEGSD |
| 1258. | EGSDS |
| 1259. | GSDSI |
| 1260. | SDSIY |
| 1261. | DSIYE |
| 1262. | SIYEI |
| 1263. | IYEIM |
| 1264. | YEIMM |
| 1265. | EIMMP |
| 1266. | IMMPI |
| 1267. | MMPIY |
| 1268. | MPIYE |
| 1269. | PIYEV |
| 1270. | IYEVM |
| 1271. | YEVMD |
| 1272. | EVMDM |
| 1273. | VMDMD |
| 1274. | MDMDL |
| 1275. | DMDLE |
| 1276. | MDLET |
| 1277. | DLETR |
| 1278. | LETRR |
| 1279. | ETRRS |
| 1280. | TRRSF |
| 1281. | RRSFA |
| 1282. | RSFAV |
| 1283. | SFAVQ |
| 1284. | FAVQQ |
| 1285. | AVQQG |
| 1286. | VQQGH |
| 1287. | QQGHY |
| 1288. | QGHYQ |
| 1289. | GHYQD |
| 1290. | HYQDP |
| 1291. | YQDPR |
| 1292. | QDPRA |
| 1293. | DPRAS |
| 1294. | PRASD |
| 1295. | RASDY |
| 1296. | ASDYD |
| 1297. | SDYDL |
| 1298. | DYDLP |
| 1299. | YDLPR |
| 1300. | DLPRA |
| 1301. | LPRAS |
| 1302. | PRASD |
| 1303. | RASDY |
| 1304. | ASDYD |
| 1305. | SDYDL |
| 1306. | DYDLP |
| 1307. | YDLPR |
| 1308. | DLPRS |
| 1309. | LPRSP |
| 1310. | PRSPY |
| 1311. | RSPYP |
| 1312. | SPYPT |
| 1313. | PYPTP |
| 1314. | YPTPP |
| 1315. | PTPPL |
| 1316. | TPPLP |
| 1317. | PPLPP |
| 1318. | PLPPR |
| 1319. | LPPRY |
| 1320. | PPRYQ |
| 1321. | PRYQL |
| 1322. | RYQLQ |
| 1323. | YQLQN |
| 1324. | QLQNM |
| 1325. | LQNMD |
| 1326. | QNMDV |
| 1327. | NMDVE |
| 1328. | MDVEA |
| 1329. | DVEAG |
| 1330. | VEAGF |
| 1331. | EAGFR |
| 1332. | AGFRE |
| 1333. | GFREA |
| 1334. | FREAV |
| 1335. | REAVY |
| 1336. | EAVYA |
| 1337. | AVYAS |
| 1338. | VYASF |
| 1339. | YASFV |
| 1340. | ASFVA |
| 1341. | SFVAG |
| 1342. | FVAGM |
| 1343. | VAGMY |
| 1344. | AGMYN |
| 1345. | GMYNY |
| 1346. | MYNYV |
| 1347. | YNYVV |
| 1348. | NYVVT |
| 1349. | YVVTQ |
| 1350. | VVTQP |
| 1351. | VTQPQ |
| 1352. | TQPQE |
| 1353. | QPQER |
| 1354. | PQERI |
| 1355. | QERIP |
| 1356. | ERIPN |
| 1357. | RIPNS |
| 1358. | IPNSQ |
| 1359. | PNSQQ |
| 1360. | NSQQV |
| 1361. | SQQVE |
| 1362. | QQVEG |
| 1363. | QVEGI |
| 1364. | VEGIL |
| 1365. | EGILR |
| 1366. | GILRD |
| 1367. | ILRDM |
| 1368. | LRDML |
| 1369. | RDMLT |
| 1370. | DMLTN |
| 1371. | MLTNG |
| 1372. | LTNGS |
| 1373. | TNGSQ |
| 1374. | NGSQT |
| 1375. | GSQTF |
| 1376. | SQTFR |
| 1377. | QTFRD |
| 1378. | TFRDL |

TABLE 6-continued

| | | |
|---|---|---|
| 1379. | FRDLM | |
| 1380. | RDLMR | |
| 1381. | DLMRR | |
| 1382. | LMRRW | |
| 1383. | MRRWN | |
| 1384. | RRWNR | |
| 1385. | RWNRE | |
| 1386. | WNREV | |
| 1387. | NREVD | |
| 1388. | REVDR | |
| 1389. | EVDRE | |

5-mer peptides of CT147 (hypothetical protein, 1449 amino acids), ACCESSION# NP 219650.1, GI: 15604866 (SEQ ID NOS: 1390-2834)

| | |
|---|---|
| 1390. | MANPS |
| 1391. | ANPST |
| 1392. | NPSTP |
| 1393. | PSTPS |
| 1394. | STPSF |
| 1395. | TPSFN |
| 1396. | PSFNH |
| 1397. | SFNHS |
| 1398. | FNHSD |
| 1399. | NHSDL |
| 1400. | HSDLS |
| 1401. | SDLSL |
| 1402. | DLSLQ |
| 1403. | LSLQG |
| 1404. | SLQGR |
| 1405. | LQGRL |
| 1406. | QGRLR |
| 1407. | GRLRA |
| 1408. | RLRAS |
| 1409. | LRASS |
| 1410. | RASSQ |
| 1411. | ASSQQ |
| 1412. | SSQQC |
| 1413. | SQQCT |
| 1414. | QQCTQ |
| 1415. | QCTQA |
| 1416. | CTQAG |
| 1417. | TQAGQ |
| 1418. | QAGQG |
| 1419. | AGQGD |
| 1420. | GQGDP |
| 1421. | QGDPQ |
| 1422. | GDPQP |
| 1423. | DPQPL |
| 1424. | PQPLS |
| 1425. | QPLSP |
| 1426. | PLSPE |
| 1427. | LSPES |
| 1428. | SPESR |
| 1429. | PESRG |
| 1430. | ESRGL |
| 1431. | SRGLT |
| 1432. | RGLTS |
| 1433. | GLTSN |
| 1434. | LTSNF |
| 1435. | TSNFS |
| 1436. | SNFST |
| 1437. | NFSTR |
| 1438. | FSTRR |
| 1439. | STRRD |
| 1440. | TRRDL |
| 1441. | RRDLI |
| 1442. | RDLID |
| 1443. | DLIDV |
| 1444. | LIDVV |
| 1445. | IDVVE |
| 1446. | DVVEE |
| 1447. | VVEES |
| 1448. | VEESI |
| 1449. | EESIE |
| 1450. | ESIET |
| 1451. | SIETA |
| 1452. | IETAK |
| 1453. | ETAKG |

TABLE 6-continued

| | |
|---|---|
| 1454. | TAKGS |
| 1455. | AKGSE |
| 1456. | KGSEL |
| 1457. | GSELK |
| 1458. | SELKK |
| 1459. | ELKKL |
| 1460. | LKKLR |
| 1461. | KKLRI |
| 1462. | KLRIY |
| 1463. | LRIYE |
| 1464. | RIYEI |
| 1465. | IYEIA |
| 1466. | YEIAL |
| 1467. | EIALK |
| 1468. | IALKI |
| 1469. | ALKIL |
| 1470. | LKILT |
| 1471. | KILTI |
| 1472. | ILTII |
| 1473. | LTIIG |
| 1474. | TIIGA |
| 1475. | IIGAA |
| 1476. | IGAAI |
| 1477. | GAAIL |
| 1478. | AAILF |
| 1479. | AILFA |
| 1480. | ILFAV |
| 1481. | LFAVP |
| 1482. | FAVPL |
| 1483. | AVPLC |
| 1484. | VPLCM |
| 1485. | PLCML |
| 1486. | LCMLL |
| 1487. | CMLLG |
| 1488. | MLLGV |
| 1489. | LLGVP |
| 1490. | LGVPL |
| 1491. | GVPLW |
| 1492. | VPLWI |
| 1493. | PLWIP |
| 1494. | LWIPI |
| 1495. | WIPIV |
| 1496. | IPIVT |
| 1497. | PIVTC |
| 1498. | IVTCI |
| 1499. | VTCIG |
| 1500. | TCIGV |
| 1501. | CIGVG |
| 1502. | IGVGI |
| 1503. | GVGIA |
| 1504. | VGIAF |
| 1505. | GIAFS |
| 1506. | IAFSI |
| 1507. | AFSIA |
| 1508. | FSIAK |
| 1509. | SIAKG |
| 1510. | IAKGC |
| 1511. | AKGCL |
| 1512. | KGCLQ |
| 1513. | GCLQK |
| 1514. | CLQKR |
| 1515. | LQKRC |
| 1516. | QKRCQ |
| 1517. | KRCQQ |
| 1518. | RCQQI |
| 1519. | CQQIR |
| 1520. | QQIRE |
| 1521. | QIREE |
| 1522. | IREEY |
| 1523. | REEYR |
| 1524. | EEYRA |
| 1525. | EYRAL |
| 1526. | YRALH |
| 1527. | RALHL |
| 1528. | ALHLY |
| 1529. | LHLYH |
| 1530. | HLYHR |
| 1531. | LYHRY |
| 1532. | YHRYL |
| 1533. | HRYLL |

TABLE 6-continued

| | |
|---|---|
| 1534. | RYLLS |
| 1535. | YLLSN |
| 1536. | LLSNK |
| 1537. | LSNKD |
| 1538. | SNKDS |
| 1539. | NKDSI |
| 1540. | KDSID |
| 1541. | DSIDG |
| 1542. | SIDGT |
| 1543. | IDGTL |
| 1544. | DGTLL |
| 1545. | GTLLS |
| 1546. | TLLSR |
| 1547. | LLSRF |
| 1548. | LSRFD |
| 1549. | SRFDI |
| 1550. | RFDIR |
| 1551. | FDIRF |
| 1552. | DIRFR |
| 1553. | IRFRK |
| 1554. | RFRKA |
| 1555. | FRKAE |
| 1556. | RKAEE |
| 1557. | KAEEK |
| 1558. | AEEKL |
| 1559. | EEKLH |
| 1560. | EKLHG |
| 1561. | KLHGL |
| 1562. | LHGLD |
| 1563. | HGLDL |
| 1564. | GLDLD |
| 1565. | LDLDK |
| 1566. | DLDKR |
| 1567. | LDKRE |
| 1568. | DKREA |
| 1569. | KREAN |
| 1570. | REANH |
| 1571. | EANHP |
| 1572. | ANHPL |
| 1573. | NHPLE |
| 1574. | HPLEA |
| 1575. | PLEAD |
| 1576. | LEADK |
| 1577. | EADKR |
| 1578. | ADKRY |
| 1579. | DKRYD |
| 1580. | KRYDF |
| 1581. | RYDFA |
| 1582. | YDFAG |
| 1583. | DFAGL |
| 1584. | FAGLA |
| 1585. | AGLAH |
| 1586. | GLAHQ |
| 1587. | LAHQR |
| 1588. | AHQRY |
| 1589. | HQRYQ |
| 1590. | QRYQV |
| 1591. | RYQVD |
| 1592. | YQVDA |
| 1593. | QVDAA |
| 1594. | VDAAL |
| 1595. | DAALG |
| 1596. | AALGI |
| 1597. | ALGIS |
| 1598. | LGISS |
| 1599. | GISSS |
| 1600. | ISSSQ |
| 1601. | SSSQD |
| 1602. | SSQDA |
| 1603. | SQDAF |
| 1604. | QDAFW |
| 1605. | DAFWR |
| 1606. | AFWRG |
| 1607. | FWRGV |
| 1608. | WRGVA |
| 1609. | RGVAQ |
| 1610. | GVAQQ |
| 1611. | VAQQV |
| 1612. | AQQVK |
| 1613. | QQVKS |

TABLE 6-continued

| | |
|---|---|
| 1614. | QVKSV |
| 1615. | VKSVK |
| 1616. | KSVKD |
| 1617. | SVKDD |
| 1618. | VKDDV |
| 1619. | KDDVV |
| 1620. | DDVVL |
| 1621. | DVVLG |
| 1622. | VVLGD |
| 1623. | VLGDK |
| 1624. | LGDKA |
| 1625. | GDKAS |
| 1626. | DKAST |
| 1627. | KASTD |
| 1628. | ASTDL |
| 1629. | STDLY |
| 1630. | TDLYP |
| 1631. | DLYPI |
| 1632. | LYPIA |
| 1633. | YPIAQ |
| 1634. | PIAQQ |
| 1635. | IAQQA |
| 1636. | AQQAL |
| 1637. | QQALQ |
| 1638. | QALQA |
| 1639. | ALQAA |
| 1640. | LQAAG |
| 1641. | QAAGV |
| 1642. | AAGVG |
| 1643. | AGVGF |
| 1644. | GVGFS |
| 1645. | VGFSG |
| 1646. | GFSGA |
| 1647. | FSGAA |
| 1648. | SGAAG |
| 1649. | GAAGK |
| 1650. | AAGKE |
| 1651. | AGKES |
| 1652. | GKESL |
| 1653. | KESLL |
| 1654. | ESLLD |
| 1655. | SLLDL |
| 1656. | LLDLA |
| 1657. | LDLAK |
| 1658. | DLAKS |
| 1659. | LAKSL |
| 1660. | AKSLS |
| 1661. | KSLSS |
| 1662. | SLSSL |
| 1663. | LSSLF |
| 1664. | SSLFA |
| 1665. | SLFAW |
| 1666. | LFAWG |
| 1667. | FAWGS |
| 1668. | AWGSQ |
| 1669. | WGSQV |
| 1670. | GSQVG |
| 1671. | SQVGK |
| 1672. | QVGKD |
| 1673. | VGKDS |
| 1674. | GKDSH |
| 1675. | KDSHE |
| 1676. | DSHEA |
| 1677. | SHEAL |
| 1678. | HEALQ |
| 1679. | EALQQ |
| 1680. | ALQQY |
| 1681. | LQQYQ |
| 1682. | QQYQM |
| 1683. | QYQMR |
| 1684. | YQMRF |
| 1685. | QMRFL |
| 1686. | MRFLS |
| 1687. | RFLSS |
| 1688. | FLSSP |
| 1689. | LSSPI |
| 1690. | SSPIL |
| 1691. | SPILA |
| 1692. | PILAT |
| 1693. | ILATW |

TABLE 6-continued

| | |
|---|---|
| 1694. | LATWC |
| 1695. | ATWCG |
| 1696. | TWCGA |
| 1697. | WCGAG |
| 1698. | CGAGF |
| 1699. | GAGFS |
| 1700. | AGFSA |
| 1701. | GFSAS |
| 1702. | FSASA |
| 1703. | SASAQ |
| 1704. | ASAQD |
| 1705. | SAQDF |
| 1706. | AQDFV |
| 1707. | QDFVL |
| 1708. | DFVLK |
| 1709. | FVLKG |
| 1710. | VLKGE |
| 1711. | LKGEN |
| 1712. | KGENI |
| 1713. | GENIL |
| 1714. | ENILD |
| 1715. | NILDI |
| 1716. | ILDIA |
| 1717. | LDIAS |
| 1718. | DIASE |
| 1719. | IASEN |
| 1720. | ASENH |
| 1721. | SENHT |
| 1722. | ENHTK |
| 1723. | NHTKM |
| 1724. | HTKMQ |
| 1725. | TKMQN |
| 1726. | KMQNA |
| 1727. | MQNAI |
| 1728. | QNAIK |
| 1729. | NAIKR |
| 1730. | AIKRV |
| 1731. | IKRVQ |
| 1732. | KRVQL |
| 1733. | RVQLV |
| 1734. | VQLVS |
| 1735. | QLVSV |
| 1736. | LVSVL |
| 1737. | VSVLG |
| 1738. | SVLGK |
| 1739. | VLGKM |
| 1740. | LGKMR |
| 1741. | GKMRN |
| 1742. | KMRNW |
| 1743. | MRNWK |
| 1744. | RNWKE |
| 1745. | NWKEK |
| 1746. | WKEKI |
| 1747. | KEKID |
| 1748. | EKIDT |
| 1749. | KIDTL |
| 1750. | IDTLI |
| 1751. | DTLIQ |
| 1752. | TLIQN |
| 1753. | LIQNK |
| 1754. | IQNKN |
| 1755. | QNKNL |
| 1756. | NKNLD |
| 1757. | KNLDQ |
| 1758. | NLDQD |
| 1759. | LDQDS |
| 1760. | DQDSL |
| 1761. | QDSLR |
| 1762. | DSLRK |
| 1763. | SLRKL |
| 1764. | LRKLY |
| 1765. | RKLYQ |
| 1766. | KLYQD |
| 1767. | LYQDI |
| 1768. | YQDIE |
| 1769. | QDIEK |
| 1770. | DIEKA |
| 1771. | IEKAM |
| 1772. | EKAMH |
| 1773. | KAMHK |
| 1774. | AMHKV |
| 1775. | MHKVC |
| 1776. | HKVCI |
| 1777. | KVCIE |
| 1778. | VCIED |
| 1779. | CIEDG |
| 1780. | IEDGV |
| 1781. | EDGVS |
| 1782. | DGVST |
| 1783. | GVSTS |
| 1784. | VSTSI |
| 1785. | STSIQ |
| 1786. | TSIQT |
| 1787. | SIQTQ |
| 1788. | IQTQV |
| 1789. | QTQVR |
| 1790. | TQVRK |
| 1791. | QVRKV |
| 1792. | VRKVT |
| 1793. | RKVTQ |
| 1794. | KVTQK |
| 1795. | VTQKY |
| 1796. | TQKYL |
| 1797. | QKYLR |
| 1798. | KYLRQ |
| 1799. | YLRQD |
| 1800. | LRQDL |
| 1801. | RQDLQ |
| 1802. | QDLQE |
| 1803. | DLQEL |
| 1804. | LQELL |
| 1805. | QELLN |
| 1806. | ELLNK |
| 1807. | LLNKK |
| 1808. | LNKKA |
| 1809. | NKKAP |
| 1810. | KKAPL |
| 1811. | KAPLN |
| 1812. | APLNE |
| 1813. | PLNES |
| 1814. | LNESD |
| 1815. | NESDL |
| 1816. | ESDLS |
| 1817. | SDLSK |
| 1818. | DLSKM |
| 1819. | LSKMQ |
| 1820. | SKMQK |
| 1821. | KMQKG |
| 1822. | MQKGI |
| 1823. | QKGIS |
| 1824. | KGISS |
| 1825. | GISSC |
| 1826. | ISSCA |
| 1827. | SSCAN |
| 1828. | SCANL |
| 1829. | CANLV |
| 1830. | ANLVV |
| 1831. | NLVVT |
| 1832. | LVVTL |
| 1833. | VVTLL |
| 1834. | VTLLE |
| 1835. | TLLES |
| 1836. | LLESQ |
| 1837. | LESQL |
| 1838. | ESQLG |
| 1839. | SQLGT |
| 1840. | QLGTS |
| 1841. | LGTSG |
| 1842. | GTSGQ |
| 1843. | TSGQT |
| 1844. | SGQTP |
| 1845. | GQTPI |
| 1846. | QTPIK |
| 1847. | TPIKE |
| 1848. | PIKEV |
| 1849. | IKEVE |
| 1850. | KEVEE |
| 1851. | EVEES |
| 1852. | VEESI |
| 1853. | EESIY |

TABLE 6-continued

| | | |
|---|---|---|
| 1854. | ESIYR | |
| 1855. | SIYRD | |
| 1856. | IYRDL | |
| 1857. | YRDLI | |
| 1858. | RDLIA | |
| 1859. | DLIAT | |
| 1860. | LIATI | |
| 1861. | IATIL | |
| 1862. | ATILQ | |
| 1863. | TILQM | |
| 1864. | ILQMG | |
| 1865. | LQMGS | |
| 1866. | QMGSA | |
| 1867. | MGSAA | |
| 1868. | GSAAG | |
| 1869. | SAAGG | |
| 1870. | AAGGV | |
| 1871. | AGGVT | |
| 1872. | GGVTP | |
| 1873. | GVTPL | |
| 1874. | VTPLV | |
| 1875. | TPLVD | |
| 1876. | PLVDG | |
| 1877. | LVDGV | |
| 1878. | VDGVH | |
| 1879. | DGVHK | |
| 1880. | GVHKA | |
| 1881. | VHKAI | |
| 1882. | HKAIR | |
| 1883. | KAIRE | |
| 1884. | AIREG | |
| 1885. | IREGK | |
| 1886. | REGKA | |
| 1887. | EGKAL | |
| 1888. | GKALR | |
| 1889. | KALRS | |
| 1890. | ALRSE | |
| 1891. | LRSEL | |
| 1892. | RSELS | |
| 1893. | SELSR | |
| 1894. | ELSRA | |
| 1895. | LSRAM | |
| 1896. | SRAMS | |
| 1897. | RAMSL | |
| 1898. | AMSLH | |
| 1899. | MSLHP | |
| 1900. | SLHPR | |
| 1901. | LHPRQ | |
| 1902. | HPRQS | |
| 1903. | PRQSF | |
| 1904. | RQSFL | |
| 1905. | QSFLG | |
| 1906. | SFLGV | |
| 1907. | FLGVQ | |
| 1908. | LGVQS | |
| 1909. | GVQSA | |
| 1910. | VQSAV | |
| 1911. | QSAVE | |
| 1912. | SAVEK | |
| 1913. | AVEKL | |
| 1914. | VEKLQ | |
| 1915. | EKLQA | |
| 1916. | KLQAF | |
| 1917. | LQAFI | |
| 1918. | QAFIR | |
| 1919. | AFIRD | |
| 1920. | FIRDP | |
| 1921. | IRDPK | |
| 1922. | RDPKW | |
| 1923. | DPKWG | |
| 1924. | PKWGA | |
| 1925. | KWGAS | |
| 1926. | WGASA | |
| 1927. | GASAV | |
| 1928. | ASAVH | |
| 1929. | SAVHT | |
| 1930. | AVHTS | |
| 1931. | VHTSA | |
| 1932. | HTSAE | |
| 1933. | TSAEE | |

TABLE 6-continued

| | | |
|---|---|---|
| 1934. | SAEET | |
| 1935. | AEETL | |
| 1936. | EETLA | |
| 1937. | ETLAQ | |
| 1938. | TLAQK | |
| 1939. | LAQKQ | |
| 1940. | AQKQK | |
| 1941. | QKQKF | |
| 1942. | KQKFV | |
| 1943. | QKFVS | |
| 1944. | KFVSD | |
| 1945. | FVSDL | |
| 1946. | VSDLT | |
| 1947. | SDLTR | |
| 1948. | DLTRI | |
| 1949. | LTRIQ | |
| 1950. | TRIQT | |
| 1951. | RIQTS | |
| 1952. | IQTSL | |
| 1953. | QTSLA | |
| 1954. | TSLAD | |
| 1955. | SLADW | |
| 1956. | LADWR | |
| 1957. | ADWRE | |
| 1958. | DWRER | |
| 1959. | WRERY | |
| 1960. | RERYG | |
| 1961. | ERYGL | |
| 1962. | RYGLF | |
| 1963. | YGLFE | |
| 1964. | GLFEE | |
| 1965. | LFEET | |
| 1966. | FEETK | |
| 1967. | EETKL | |
| 1968. | ETKLN | |
| 1969. | TKLNH | |
| 1970. | KLNHI | |
| 1971. | LNHIV | |
| 1972. | NHIVS | |
| 1973. | HIVST | |
| 1974. | IVSTD | |
| 1975. | VSTDF | |
| 1976. | STDFV | |
| 1977. | TDFVS | |
| 1978. | DFVSR | |
| 1979. | FVSRT | |
| 1980. | VSRTE | |
| 1981. | SRTEA | |
| 1982. | RTEAF | |
| 1983. | TEAFL | |
| 1984. | EAFLD | |
| 1985. | AFLDT | |
| 1986. | FLDTL | |
| 1987. | LDTLK | |
| 1988. | DTLKN | |
| 1989. | TLKNV | |
| 1990. | LKNVA | |
| 1991. | KNVAE | |
| 1992. | NVAEA | |
| 1993. | VAEAC | |
| 1994. | AEACS | |
| 1995. | EACSL | |
| 1996. | ACSLE | |
| 1997. | CSLEQ | |
| 1998. | SLEQA | |
| 1999. | LEQAV | |
| 2000. | EQAVA | |
| 2001. | QAVAE | |
| 2002. | AVAEL | |
| 2003. | VAELK | |
| 2004. | AELKD | |
| 2005. | ELKDC | |
| 2006. | LKDCE | |
| 2007. | KDCED | |
| 2008. | DCEDA | |
| 2009. | CEDAM | |
| 2010. | EDAMK | |
| 2011. | DAMKA | |
| 2012. | AMKAD | |
| 2013. | MKADL | |

TABLE 6-continued

| | |
|---|---|
| 2014. | KADLT |
| 2015. | ADLTH |
| 2016. | DLTHV |
| 2017. | LTHVE |
| 2018. | THVEQ |
| 2019. | HVEQK |
| 2020. | VEQKM |
| 2021. | EQKMN |
| 2022. | QKMNP |
| 2023. | KMNPT |
| 2024. | MNPTE |
| 2025. | NPTEI |
| 2026. | PTEIE |
| 2027. | TEIES |
| 2028. | EIESA |
| 2029. | IESAR |
| 2030. | ESARE |
| 2031. | SAREE |
| 2032. | AREEF |
| 2033. | REEFK |
| 2034. | EEFKR |
| 2035. | EFKRL |
| 2036. | FKRLM |
| 2037. | KRLME |
| 2038. | RLMEE |
| 2039. | LMEEL |
| 2040. | MEELA |
| 2041. | EELAG |
| 2042. | ELAGI |
| 2043. | LAGIQ |
| 2044. | AGIQE |
| 2045. | GIQEQ |
| 2046. | IQEQL |
| 2047. | QEQLE |
| 2048. | EQLEQ |
| 2049. | QLEQI |
| 2050. | LEQIA |
| 2051. | EQIAQ |
| 2052. | QIAQP |
| 2053. | IAQPI |
| 2054. | AQPIY |
| 2055. | QPIYE |
| 2056. | PIYEE |
| 2057. | IYEEG |
| 2058. | YEEGV |
| 2059. | EEGVS |
| 2060. | EGVSG |
| 2061. | GVSGE |
| 2062. | VSGER |
| 2063. | SGERL |
| 2064. | GERLL |
| 2065. | ERLLL |
| 2066. | RLLLN |
| 2067. | LLLNT |
| 2068. | LLNTV |
| 2069. | LNTVF |
| 2070. | NTVFF |
| 2071. | TVFFH |
| 2072. | VFFHP |
| 2073. | FFHPE |
| 2074. | FHPEV |
| 2075. | HPEVL |
| 2076. | PEVLR |
| 2077. | EVLRK |
| 2078. | VLRKK |
| 2079. | LRKKV |
| 2080. | RKKVQ |
| 2081. | KKVQA |
| 2082. | KVQAK |
| 2083. | VQAKE |
| 2084. | QAKEA |
| 2085. | AKEAS |
| 2086. | KEASL |
| 2087. | EASLE |
| 2088. | ASLEA |
| 2089. | SLEAL |
| 2090. | LEALT |
| 2091. | EALTK |
| 2092. | ALTKG |
| 2093. | LTKGE |
| 2094. | TKGEQ |
| 2095. | KGEQP |
| 2096. | GEQPS |
| 2097. | EQPSP |
| 2098. | QPSPT |
| 2099. | PSPTK |
| 2100. | SPTKK |
| 2101. | PTKKK |
| 2102. | TKKKT |
| 2103. | KKKTL |
| 2104. | KKTLK |
| 2105. | KTLKQ |
| 2106. | TLKQL |
| 2107. | LKQLS |
| 2108. | KQLSE |
| 2109. | QLSEG |
| 2110. | LSEGC |
| 2111. | SEGCE |
| 2112. | EGCEY |
| 2113. | GCEYF |
| 2114. | CEYFS |
| 2115. | EYFSS |
| 2116. | YFSSL |
| 2117. | FSSLV |
| 2118. | SSLVS |
| 2119. | SLVSK |
| 2120. | LVSKI |
| 2121. | VSKIN |
| 2122. | SKINA |
| 2123. | KINAL |
| 2124. | INALK |
| 2125. | NALKT |
| 2126. | ALKTI |
| 2127. | LKTIL |
| 2128. | KTILE |
| 2129. | TILEG |
| 2130. | ILEGS |
| 2131. | LEGSR |
| 2132. | EGSRG |
| 2133. | GSRGK |
| 2134. | SRGKK |
| 2135. | RGKKI |
| 2136. | GKKIA |
| 2137. | KKIAS |
| 2138. | KIASQ |
| 2139. | IASQD |
| 2140. | ASQDI |
| 2141. | SQDIR |
| 2142. | QDIRQ |
| 2143. | DIRQL |
| 2144. | IRQLI |
| 2145. | RQLIG |
| 2146. | QLIGL |
| 2147. | LIGLT |
| 2148. | IGLTD |
| 2149. | GLTDE |
| 2150. | LTDEL |
| 2151. | TDELA |
| 2152. | DELAL |
| 2153. | ELALE |
| 2154. | LALEL |
| 2155. | ALELS |
| 2156. | LELSS |
| 2157. | ELSSF |
| 2158. | LSSFQ |
| 2159. | SSFQQ |
| 2160. | SFQQD |
| 2161. | FQQDS |
| 2162. | QQDSL |
| 2163. | QDSLE |
| 2164. | DSLES |
| 2165. | SLESL |
| 2166. | LESLL |
| 2167. | ESLLY |
| 2168. | SLLYG |
| 2169. | LLYGL |
| 2170. | LYGLE |
| 2171. | YGLEG |
| 2172. | GLEGL |
| 2173. | LEGLS |

TABLE 6-continued

| | |
|---|---|
| 2174. | EGLSI |
| 2175. | GLSIP |
| 2176. | LSIPA |
| 2177. | SIPAA |
| 2178. | IPAAS |
| 2179. | PAASI |
| 2180. | AASIE |
| 2181. | ASIEQ |
| 2182. | SIEQK |
| 2183. | IEQKK |
| 2184. | EQKKG |
| 2185. | QKKGS |
| 2186. | KKGSP |
| 2187. | KGSPK |
| 2188. | GSPKS |
| 2189. | SPKSS |
| 2190. | PKSSS |
| 2191. | KSSSI |
| 2192. | SSSIA |
| 2193. | SSIAE |
| 2194. | SIAEK |
| 2195. | IAEKV |
| 2196. | AEKVV |
| 2197. | EKVVY |
| 2198. | KVVYA |
| 2199. | VVYAS |
| 2200. | VYASH |
| 2201. | YASHQ |
| 2202. | ASHQR |
| 2203. | SHQRV |
| 2204. | HQRVH |
| 2205. | QRVHN |
| 2206. | RVHNG |
| 2207. | VHNGV |
| 2208. | HNGVK |
| 2209. | NGVKA |
| 2210. | GVKAK |
| 2211. | VKAKV |
| 2212. | KAKVN |
| 2213. | AKVNR |
| 2214. | KVNRT |
| 2215. | VNRTL |
| 2216. | NRTLE |
| 2217. | RTLEA |
| 2218. | TLEAF |
| 2219. | LEAFS |
| 2220. | EAFSQ |
| 2221. | AFSQL |
| 2222. | FSQLI |
| 2223. | SQLIK |
| 2224. | QLIKG |
| 2225. | LIKGL |
| 2226. | IKGLR |
| 2227. | KGLRG |
| 2228. | GLRGS |
| 2229. | LRGSL |
| 2230. | RGSLR |
| 2231. | GSLRN |
| 2232. | SLRNA |
| 2233. | LRNAM |
| 2234. | RNAMI |
| 2235. | NAMIT |
| 2236. | AMITK |
| 2237. | MITKA |
| 2238. | ITKAV |
| 2239. | TKAVV |
| 2240. | KAVVA |
| 2241. | AVVAA |
| 2242. | VVAAV |
| 2243. | VAAVL |
| 2244. | AAVLS |
| 2245. | AVLSV |
| 2246. | VLSVA |
| 2247. | LSVAF |
| 2248. | SVAFS |
| 2249. | VAFSC |
| 2250. | AFSCL |
| 2251. | FSCLA |
| 2252. | SCLAI |
| 2253. | CLAIA |

TABLE 6-continued

| | |
|---|---|
| 2254. | LAIAL |
| 2255. | AIALF |
| 2256. | IALFS |
| 2257. | ALFSV |
| 2258. | LFSVQ |
| 2259. | FSVQL |
| 2260. | SVQLT |
| 2261. | VQLTW |
| 2262. | QLTWL |
| 2263. | LTWLP |
| 2264. | TWLPI |
| 2265. | WLPIM |
| 2266. | LPIML |
| 2267. | PIMLC |
| 2268. | IMLCV |
| 2269. | MLCVL |
| 2270. | LCVLA |
| 2271. | CVLAL |
| 2272. | VLALV |
| 2273. | LALVL |
| 2274. | ALVLE |
| 2275. | LVLEA |
| 2276. | VLEAI |
| 2277. | LEAIP |
| 2278. | EAIPS |
| 2279. | AIPSA |
| 2280. | IPSAL |
| 2281. | PSALS |
| 2282. | SALSI |
| 2283. | ALSIW |
| 2284. | LSIWV |
| 2285. | SIWVE |
| 2286. | IWVEK |
| 2287. | WVEKR |
| 2288. | VEKRN |
| 2289. | EKRNW |
| 2290. | KRNWK |
| 2291. | RNWKY |
| 2292. | NWKYE |
| 2293. | WKYEV |
| 2294. | KYEVA |
| 2295. | YEVAS |
| 2296. | EVASL |
| 2297. | VASLA |
| 2298. | ASLAK |
| 2299. | SLAKQ |
| 2300. | LAKQL |
| 2301. | AKQLV |
| 2302. | KQLVS |
| 2303. | QLVSD |
| 2304. | LVSDG |
| 2305. | VSDGR |
| 2306. | SDGRK |
| 2307. | DGRKL |
| 2308. | GRKLP |
| 2309. | RKLPY |
| 2310. | KLPYP |
| 2311. | LPYPD |
| 2312. | PYPDL |
| 2313. | YPDLG |
| 2314. | PDLGD |
| 2315. | DLGDQ |
| 2316. | LGDQN |
| 2317. | GDQNI |
| 2318. | DQNIK |
| 2319. | QNIKH |
| 2320. | NIKHL |
| 2321. | IKHLE |
| 2322. | KHLEK |
| 2323. | HLEKI |
| 2324. | LEKIR |
| 2325. | EKIRD |
| 2326. | KIRDV |
| 2327. | IRDVY |
| 2328. | RDVYG |
| 2329. | DVYGL |
| 2330. | VYGLD |
| 2331. | YGLDG |
| 2332. | GLDGV |
| 2333. | LDGVA |

TABLE 6-continued

| | |
|---|---|
| 2334. | DGVAE |
| 2335. | GVAEL |
| 2336. | VAELR |
| 2337. | AELRV |
| 2338. | ELRVA |
| 2339. | LRVAE |
| 2340. | RVAEA |
| 2341. | VAEAA |
| 2342. | AEAAL |
| 2343. | EAALL |
| 2344. | AALLG |
| 2345. | ALLGV |
| 2346. | LLGVQ |
| 2347. | LGVQK |
| 2348. | GVQKL |
| 2349. | VQKLP |
| 2350. | QKLPE |
| 2351. | KLPEE |
| 2352. | LPEEQ |
| 2353. | PEEQK |
| 2354. | EEQKQ |
| 2355. | EQKQE |
| 2356. | QKQES |
| 2357. | KQESL |
| 2358. | QESLK |
| 2359. | ESLKS |
| 2360. | SLKSA |
| 2361. | LKSAV |
| 2362. | KSAVK |
| 2363. | SAVKA |
| 2364. | AVKAL |
| 2365. | VKALR |
| 2366. | KALRA |
| 2367. | ALRAD |
| 2368. | LRADA |
| 2369. | RADAK |
| 2370. | ADAKV |
| 2371. | DAKVL |
| 2372. | AKVLN |
| 2373. | KVLNK |
| 2374. | VLNKK |
| 2375. | LNKKF |
| 2376. | NKKFK |
| 2377. | KKFKK |
| 2378. | KFKKL |
| 2379. | FKKLP |
| 2380. | KKLPE |
| 2381. | KLPES |
| 2382. | LPESY |
| 2383. | PESYQ |
| 2384. | ESYQP |
| 2385. | SYQPQ |
| 2386. | YQPQH |
| 2387. | QPQHS |
| 2388. | PQHSE |
| 2389. | QHSEV |
| 2390. | HSEVT |
| 2391. | SEVTG |
| 2392. | EVTGV |
| 2393. | VTGVQ |
| 2394. | TGVQG |
| 2395. | GVQGV |
| 2396. | VQGVT |
| 2397. | QGVTE |
| 2398. | GVTEQ |
| 2399. | VTEQE |
| 2400. | TEQES |
| 2401. | EQESR |
| 2402. | QESRD |
| 2403. | ESRDD |
| 2404. | SRDDV |
| 2405. | RDDVL |
| 2406. | DDVLV |
| 2407. | DVLVA |
| 2408. | VLVAQ |
| 2409. | LVAQD |
| 2410. | VAQDM |
| 2411. | AQDMA |
| 2412. | QDMAA |
| 2413. | DMAAI |

TABLE 6-continued

| | |
|---|---|
| 2414. | MAAIE |
| 2415. | AAIEE |
| 2416. | AIEEL |
| 2417. | IEELQ |
| 2418. | EELQD |
| 2419. | ELQDQ |
| 2420. | LQDQY |
| 2421. | QDQYH |
| 2422. | DQYHA |
| 2423. | QYHAA |
| 2424. | YHAAC |
| 2425. | HAACL |
| 2426. | AACLQ |
| 2427. | ACLQF |
| 2428. | CLQFE |
| 2429. | LQFES |
| 2430. | QFESV |
| 2431. | FESVS |
| 2432. | ESVST |
| 2433. | SVSTR |
| 2434. | VSTRF |
| 2435. | STRFL |
| 2436. | TRFLA |
| 2437. | RFLAE |
| 2438. | FLAEQ |
| 2439. | LAEQR |
| 2440. | AEQRK |
| 2441. | EQRKA |
| 2442. | QRKAK |
| 2443. | RKAKF |
| 2444. | KAKFL |
| 2445. | AKFLE |
| 2446. | KFLEE |
| 2447. | FLEEL |
| 2448. | LEELL |
| 2449. | EELLV |
| 2450. | ELLVQ |
| 2451. | LLVQK |
| 2452. | LVQKR |
| 2453. | VQKRR |
| 2454. | QKRRD |
| 2455. | KRRDV |
| 2456. | RRDVS |
| 2457. | RDVSH |
| 2458. | DVSHL |
| 2459. | VSHLS |
| 2460. | SHLSH |
| 2461. | HLSHQ |
| 2462. | LSHQE |
| 2463. | SHQEA |
| 2464. | HQEAH |
| 2465. | QEAHY |
| 2466. | EAHYT |
| 2467. | AHYTQ |
| 2468. | HYTQV |
| 2469. | YTQVV |
| 2470. | TQVVS |
| 2471. | QVVSH |
| 2472. | VVSHL |
| 2473. | VSHLK |
| 2474. | SHLKE |
| 2475. | HLKEL |
| 2476. | LKELI |
| 2477. | KELIS |
| 2478. | ELISM |
| 2479. | LISMR |
| 2480. | ISMRK |
| 2481. | SMRKG |
| 2482. | MRKGA |
| 2483. | RKGAS |
| 2484. | KGAST |
| 2485. | GASTQ |
| 2486. | ASTQH |
| 2487. | STQHA |
| 2488. | TQHAS |
| 2489. | QHASK |
| 2490. | HASKE |
| 2491. | ASKEE |
| 2492. | SKEET |
| 2493. | KEEIS |

TABLE 6-continued

| | |
|---|---|
| 2494. | EEIST |
| 2495. | EISTK |
| 2496. | ISTKM |
| 2497. | STKMR |
| 2498. | TKMRE |
| 2499. | KMREL |
| 2500. | MRELL |
| 2501. | RELLS |
| 2502. | ELLSL |
| 2503. | LLSLD |
| 2504. | LSLDD |
| 2505. | SLDDQ |
| 2506. | LDDQL |
| 2507. | DDQLL |
| 2508. | DQLLK |
| 2509. | QLLKA |
| 2510. | LLKAH |
| 2511. | LKAHT |
| 2512. | KAHTA |
| 2513. | AHTAQ |
| 2514. | HTAQD |
| 2515. | TAQDV |
| 2516. | AQDVN |
| 2517. | QDVNR |
| 2518. | DVNRD |
| 2519. | VNRDN |
| 2520. | NRDNS |
| 2521. | RDNSI |
| 2522. | DNSIN |
| 2523. | NSING |
| 2524. | SINGQ |
| 2525. | INGQL |
| 2526. | NGQLQ |
| 2527. | GQLQQ |
| 2528. | QLQQQ |
| 2529. | LQQQF |
| 2530. | QQQFK |
| 2531. | QQFKK |
| 2532. | QFKKL |
| 2533. | FKKLS |
| 2534. | KKLSE |
| 2535. | KLSEE |
| 2536. | LSEEG |
| 2537. | SEEGS |
| 2538. | EEGSL |
| 2539. | EGSLQ |
| 2540. | GSLQK |
| 2541. | SLQKV |
| 2542. | LQKVK |
| 2543. | QKVKA |
| 2544. | KVKAL |
| 2545. | VKALL |
| 2546. | KALLE |
| 2547. | ALLEL |
| 2548. | LLELN |
| 2549. | LELNM |
| 2550. | ELNMC |
| 2551. | LNMCL |
| 2552. | NMCLG |
| 2553. | MCLGN |
| 2554. | CLGNA |
| 2555. | LGNAG |
| 2556. | GNAGQ |
| 2557. | NAGQT |
| 2558. | AGQTL |
| 2559. | GQTLY |
| 2560. | QTLYH |
| 2561. | TLYHS |
| 2562. | LYHSR |
| 2563. | YHSRL |
| 2564. | HSRLK |
| 2565. | SRLKR |
| 2566. | RLKRE |
| 2567. | LKREV |
| 2568. | KREVF |
| 2569. | REVFE |
| 2570. | EVFEA |
| 2571. | VFEAS |
| 2572. | FEASL |
| 2573. | EASLS |
| 2574. | ASLSG |
| 2575. | SLSGT |
| 2576. | LSGTS |
| 2577. | SGTSR |
| 2578. | GTSRQ |
| 2579. | TSRQL |
| 2580. | SRQLL |
| 2581. | RQLLQ |
| 2582. | QLLQY |
| 2583. | LLQYG |
| 2584. | LQYGE |
| 2585. | QYGED |
| 2586. | YGEDL |
| 2587. | GEDLF |
| 2588. | EDLFA |
| 2589. | DLFAS |
| 2590. | LFASY |
| 2591. | FASYD |
| 2592. | ASYDG |
| 2593. | SYDGS |
| 2594. | YDGSD |
| 2595. | DGSDR |
| 2596. | GSDRS |
| 2597. | SDRSA |
| 2598. | DRSAL |
| 2599. | RSALL |
| 2600. | SALLR |
| 2601. | ALLRF |
| 2602. | LLRFV |
| 2603. | LRFVL |
| 2604. | RFVLG |
| 2605. | FVLGS |
| 2606. | VLGSG |
| 2607. | LGSGY |
| 2608. | GSGYE |
| 2609. | SGYEM |
| 2610. | GYEMI |
| 2611. | YEMIS |
| 2612. | EMISE |
| 2613. | MISEA |
| 2614. | ISEAS |
| 2615. | SEASS |
| 2616. | EASSE |
| 2617. | ASSEL |
| 2618. | SSELK |
| 2619. | SELKS |
| 2620. | ELKSL |
| 2621. | LKSLR |
| 2622. | KSLRK |
| 2623. | SLRKR |
| 2624. | LRKRW |
| 2625. | RKRWK |
| 2626. | KRWKR |
| 2627. | RWKRS |
| 2628. | WKRSA |
| 2629. | KRSAS |
| 2630. | RSASQ |
| 2631. | SASQA |
| 2632. | ASQAA |
| 2633. | SQAAI |
| 2634. | QAAIA |
| 2635. | AAIAP |
| 2636. | AIAPE |
| 2637. | IAPED |
| 2638. | APEDY |
| 2639. | PEDYE |
| 2640. | EDYEK |
| 2641. | DYEKV |
| 2642. | YEKVC |
| 2643. | EKVCR |
| 2644. | KVCRV |
| 2645. | VCRVL |
| 2646. | CRVLE |
| 2647. | RVLER |
| 2648. | VLERF |
| 2649. | LERFL |
| 2650. | ERFLK |
| 2651. | RFLKA |
| 2652. | FLKAR |
| 2653. | LKARD |

TABLE 6-continued

| | |
|---|---|
| 2654. | KARDS |
| 2655. | ARDSL |
| 2656. | RDSLR |
| 2657. | DSLRP |
| 2658. | SLRPK |
| 2659. | LRPKL |
| 2660. | RPKLG |
| 2661. | PKLGL |
| 2662. | KLGLP |
| 2663. | LGLPL |
| 2664. | GLPLG |
| 2665. | LPLGK |
| 2666. | PLGKS |
| 2667. | LGKSS |
| 2668. | GKSSD |
| 2669. | KSSDA |
| 2670. | SSDAT |
| 2671. | SDATV |
| 2672. | DATVG |
| 2673. | ATVGL |
| 2674. | TVGLQ |
| 2675. | VGLQH |
| 2676. | GLQHQ |
| 2677. | LQHQI |
| 2678. | QHQIR |
| 2679. | HQIRD |
| 2680. | QIRDN |
| 2681. | IRDNQ |
| 2682. | RDNQR |
| 2683. | DNQRV |
| 2684. | NQRVK |
| 2685. | QRVKA |
| 2686. | RVKAR |
| 2687. | VKARV |
| 2688. | KARVT |
| 2689. | ARVTA |
| 2690. | RVTAC |
| 2691. | VTACY |
| 2692. | TACYQ |
| 2693. | ACYQE |
| 2694. | CYQES |
| 2695. | YQESC |
| 2696. | QESCR |
| 2697. | ESCRN |
| 2698. | SCRNV |
| 2699. | CRNVL |
| 2700. | RNVLQ |
| 2701. | NVLQH |
| 2702. | VLQHL |
| 2703. | LQHLE |
| 2704. | QHLED |
| 2705. | HLEDW |
| 2706. | LEDWV |
| 2707. | EDWVR |
| 2708. | DWVRK |
| 2709. | WVRKT |
| 2710. | VRKTR |
| 2711. | RKTRQ |
| 2712. | KTRQE |
| 2713. | TRQES |
| 2714. | RQESA |
| 2715. | QESAE |
| 2716. | ESAEC |
| 2717. | SAECQ |
| 2718. | AECQK |
| 2719. | ECQKV |
| 2720. | CQKVE |
| 2721. | QKVET |
| 2722. | KVETK |
| 2723. | VETKI |
| 2724. | ETKIR |
| 2725. | TKIRE |
| 2726. | KIREF |
| 2727. | IREFC |
| 2728. | REFCQ |
| 2729. | EFCQK |
| 2730. | FCQKA |
| 2731. | CQKAG |
| 2732. | QKAGS |
| 2733. | KAGSK |
| 2734. | AGSKE |
| 2735. | GSKEN |
| 2736. | SKENL |
| 2737. | KENLA |
| 2738. | ENLAE |
| 2739. | NLAES |
| 2740. | LAEST |
| 2741. | AESTE |
| 2742. | ESTEM |
| 2743. | STEML |
| 2744. | TEMLF |
| 2745. | EMLFS |
| 2746. | MLFSS |
| 2747. | LFSSL |
| 2748. | FSSLE |
| 2749. | SSLEE |
| 2750. | SLEED |
| 2751. | LEEDL |
| 2752. | EEDLN |
| 2753. | EDLNK |
| 2754. | DLNKI |
| 2755. | LNKIP |
| 2756. | NKIPL |
| 2757. | KIPLD |
| 2758. | IPLDV |
| 2759. | PLDVL |
| 2760. | LDVLR |
| 2761. | DVLRA |
| 2762. | VLRAI |
| 2763. | LRAIL |
| 2764. | RAILR |
| 2765. | AILRS |
| 2766. | ILRSL |
| 2767. | LRSLS |
| 2768. | RSLSS |
| 2769. | SLSSK |
| 2770. | LSSKV |
| 2771. | SSKVL |
| 2772. | SKVLH |
| 2773. | KVLHI |
| 2774. | VLHIR |
| 2775. | LHIRD |
| 2776. | HIRDQ |
| 2777. | IRDQK |
| 2778. | RDQKL |
| 2779. | DQKLE |
| 2780. | QKLEL |
| 2781. | KLELE |
| 2782. | LELEK |
| 2783. | ELEKL |
| 2784. | LEKLE |
| 2785. | EKLEE |
| 2786. | KLEEQ |
| 2787. | LEEQF |
| 2788. | EEQFA |
| 2789. | EQFAK |
| 2790. | QFAKT |
| 2791. | FAKTN |
| 2792. | AKTNA |
| 2793. | KTNAI |
| 2794. | TNAIV |
| 2795. | NAIVK |
| 2796. | AIVKA |
| 2797. | IVKAK |
| 2798. | VKAKE |
| 2799. | KAKEA |
| 2800. | AKEAE |
| 2801. | KEAEF |
| 2802. | EAEFE |
| 2803. | AEFEK |
| 2804. | EFEKN |
| 2805. | FEKNG |
| 2806. | EKNGE |
| 2807. | KNGEV |
| 2808. | NGEVW |
| 2809. | GEVWH |
| 2810. | EVWHN |
| 2811. | VWHNQ |
| 2812. | WHNQY |
| 2813. | HNQYQ |

TABLE 6-continued

| | |
|---|---|
| 2814. | NQYQM |
| 2815. | QYQML |
| 2816. | YQMLK |
| 2817. | QMLKS |
| 2818. | MLKSQ |
| 2819. | LKSQM |
| 2820. | KSQME |
| 2821. | SQMEK |
| 2822. | QMEKL |
| 2823. | MEKLE |
| 2824. | EKLES |
| 2825. | KLESQ |
| 2826. | LESQK |
| 2827. | ESQKR |
| 2828. | SQKRR |
| 2829. | QKRRL |
| 2830. | KRRLT |
| 2831. | RRLTD |
| 2832. | RLTDK |
| 2833. | LTDKK |
| 2834. | TDKKE |

5-mer peptides of HSP60 (CT110, 544 amino acids), ACCESSION# AAS19616.1, GI: 42541742 (SEQ ID NOS: 2835-3374)

| | |
|---|---|
| 2835. | MVAKN |
| 2836. | VAKNI |
| 2837. | AKNIK |
| 2838. | KNIKY |
| 2839. | NIKYN |
| 2840. | IKYNE |
| 2841. | KYNEE |
| 2842. | YNEEA |
| 2843. | NEEAR |
| 2844. | EEARK |
| 2845. | EARKK |
| 2846. | ARKKI |
| 2847. | RKKIQ |
| 2848. | KKIQK |
| 2849. | KIQKG |
| 2850. | IQKGV |
| 2851. | QKGVK |
| 2852. | KGVKT |
| 2853. | GVKTL |
| 2854. | VKTLA |
| 2855. | KTLAE |
| 2856. | TLAEA |
| 2857. | LAEAV |
| 2858. | AEAVK |
| 2859. | EAVKV |
| 2860. | AVKVT |
| 2861. | VKVTL |
| 2862. | KVTLG |
| 2863. | VTLGP |
| 2864. | TLGPK |
| 2865. | LGPKG |
| 2866. | GPKGR |
| 2867. | PKGRH |
| 2868. | KGRHV |
| 2869. | GRHVV |
| 2870. | RHVVI |
| 2871. | HVVID |
| 2872. | VVIDK |
| 2873. | VIDKS |
| 2874. | IDKSF |
| 2875. | DKSFG |
| 2876. | KSFGS |
| 2877. | SFGSP |
| 2878. | FGSPQ |
| 2879. | GSPQV |
| 2880. | SPQVT |
| 2881. | PQVTK |
| 2882. | QVTKD |
| 2883. | VTKDG |
| 2884. | TKDGV |
| 2885. | KDGVT |
| 2886. | DGVTV |
| 2887. | GVTVA |
| 2888. | VTVAK |
| 2889. | TVAKE |
| 2890. | VAKEV |
| 2891. | AKEVE |
| 2892. | KEVEL |
| 2893. | EVELA |
| 2894. | VELAD |
| 2895. | ELADK |
| 2896. | LADKH |
| 2897. | ADKHE |
| 2898. | DKHEN |
| 2899. | KHENM |
| 2900. | HENMG |
| 2901. | ENMGA |
| 2902. | NMGAQ |
| 2903. | MGAQM |
| 2904. | GAQMV |
| 2905. | AQMVK |
| 2906. | QMVKE |
| 2907. | MVKEV |
| 2908. | VKEVA |
| 2909. | KEVAS |
| 2910. | EVASK |
| 2911. | VASKT |
| 2912. | ASKTA |
| 2913. | SKTAD |
| 2914. | KTADK |
| 2915. | TADKA |
| 2916. | ADKAG |
| 2917. | DKAGD |
| 2918. | KAGDG |
| 2919. | AGDGT |
| 2920. | GDGTT |
| 2921. | DGTTT |
| 2922. | GTTTA |
| 2923. | TTTAT |
| 2924. | TTATV |
| 2925. | TATVL |
| 2926. | ATVLA |
| 2927. | TVLAE |
| 2928. | VLAEA |
| 2929. | LAEAI |
| 2930. | AEAIY |
| 2931. | EAIYT |
| 2932. | AIYTE |
| 2933. | IYTEG |
| 2934. | YTEGL |
| 2935. | TEGLR |
| 2936. | EGLRN |
| 2937. | GLRNV |
| 2938. | LRNVT |
| 2939. | RNVTA |
| 2940. | NVTAG |
| 2941. | VTAGA |
| 2942. | TAGAN |
| 2943. | AGANP |
| 2944. | GANPM |
| 2945. | ANPMD |
| 2946. | NPMDL |
| 2947. | PMDLK |
| 2948. | MDLKR |
| 2949. | DLKRG |
| 2950. | LKRGI |
| 2951. | KRGID |
| 2952. | RGIDK |
| 2953. | GIDKA |
| 2954. | IDKAV |
| 2955. | DKAVK |
| 2956. | KAVKV |
| 2957. | AVKVV |
| 2958. | VKVVV |
| 2959. | KVVVD |
| 2960. | VVVDQ |
| 2961. | VVDQI |
| 2962. | VDQIR |
| 2963. | DQIRK |
| 2964. | QIRKI |
| 2965. | IRKIS |
| 2966. | RKISK |
| 2967. | KISKP |
| 2968. | ISKPV |

TABLE 6-continued

| | |
|---|---|
| 2969. | SKPVQ |
| 2970. | KPVQH |
| 2971. | PVQHH |
| 2972. | VQHHK |
| 2973. | QHHKE |
| 2974. | HHKEI |
| 2975. | HKEIA |
| 2976. | KEIAQ |
| 2977. | EIAQV |
| 2978. | IAQVA |
| 2979. | AQVAT |
| 2980. | QVATI |
| 2981. | VATIS |
| 2982. | ATISA |
| 2983. | TISAN |
| 2984. | ISANN |
| 2985. | SANND |
| 2986. | ANNDA |
| 2987. | NNDAE |
| 2988. | NDAEI |
| 2989. | DAEIG |
| 2990. | AEIGN |
| 2991. | EIGNL |
| 2992. | IGNLI |
| 2993. | GNLIA |
| 2994. | NLIAE |
| 2995. | LIAEA |
| 2996. | IAEAM |
| 2997. | AEAME |
| 2998. | EAMEK |
| 2999. | AMEKV |
| 3000. | MEKVG |
| 3001. | EKVGK |
| 3002. | KVGKN |
| 3003. | VGKNG |
| 3004. | GKNGS |
| 3005. | KNGSI |
| 3006. | NGSIT |
| 3007. | GSITV |
| 3008. | SITVE |
| 3009. | ITVEE |
| 3010. | TVEEA |
| 3011. | VEEAK |
| 3012. | EEAKG |
| 3013. | EAKGF |
| 3014. | AKGFE |
| 3015. | KGFET |
| 3016. | GFETV |
| 3017. | FETVL |
| 3018. | ETVLD |
| 3019. | TVLDV |
| 3020. | VLDVV |
| 3021. | LDVVE |
| 3022. | DVVEG |
| 3023. | VVEGM |
| 3024. | VEGMN |
| 3025. | EGMNF |
| 3026. | GMNFN |
| 3027. | MNFNR |
| 3028. | NFNRG |
| 3029. | FNRGY |
| 3030. | NRGYL |
| 3031. | RGYLS |
| 3032. | GYLSS |
| 3033. | YLSSY |
| 3034. | LSSYF |
| 3035. | SSYFA |
| 3036. | SYFAT |
| 3037. | YFATN |
| 3038. | FATNP |
| 3039. | ATNPE |
| 3040. | TNPET |
| 3041. | NPETQ |
| 3042. | PETQE |
| 3043. | ETQEC |
| 3044. | TQECV |
| 3045. | QECVL |
| 3046. | ECVLE |
| 3047. | CVLED |
| 3048. | VLEDA |
| 3049. | LEDAL |
| 3050. | EDALV |
| 3051. | DALVL |
| 3052. | ALVLI |
| 3053. | LVLIY |
| 3054. | VLIYD |
| 3055. | LIYDK |
| 3056. | IYDKK |
| 3057. | YDKKI |
| 3058. | DKKIS |
| 3059. | KKISG |
| 3060. | KISGI |
| 3061. | ISGIK |
| 3062. | SGIKD |
| 3063. | GIKDF |
| 3064. | IKDFL |
| 3065. | KDFLP |
| 3066. | DFLPV |
| 3067. | FLPVL |
| 3068. | LPVLQ |
| 3069. | PVLQQ |
| 3070. | VLQQV |
| 3071. | LQQVA |
| 3072. | QQVAE |
| 3073. | QVAES |
| 3074. | VAESG |
| 3075. | AESGR |
| 3076. | ESGRP |
| 3077. | SGRPL |
| 3078. | GRPLL |
| 3079. | RPLLI |
| 3080. | PLLII |
| 3081. | LLIIA |
| 3082. | LIIAE |
| 3083. | IIAED |
| 3084. | IAEDI |
| 3085. | AEDIE |
| 3086. | EDIEG |
| 3087. | DIEGE |
| 3088. | IEGEA |
| 3089. | EGEAL |
| 3090. | GEALA |
| 3091. | EALAT |
| 3092. | ALATL |
| 3093. | LATLV |
| 3094. | ATLVV |
| 3095. | TLVVN |
| 3096. | LVVNR |
| 3097. | VVNRI |
| 3098. | VNRIR |
| 3099. | NRIRG |
| 3100. | RIRGG |
| 3101. | IRGGF |
| 3102. | RGGFR |
| 3103. | GGFRV |
| 3104. | GFRVC |
| 3105. | FRVCA |
| 3106. | RVCAV |
| 3107. | VCAVK |
| 3108. | CAVKA |
| 3109. | AVKAP |
| 3110. | VKAPG |
| 3111. | KAPGF |
| 3112. | APGFG |
| 3113. | PGFGD |
| 3114. | GFGDR |
| 3115. | FGDRR |
| 3116. | GDRRK |
| 3117. | DRRKA |
| 3118. | RRKAM |
| 3119. | RKAML |
| 3120. | KAMLE |
| 3121. | AMLED |
| 3122. | MLEDI |
| 3123. | LEDIA |
| 3124. | EDIAI |
| 3125. | DIAIL |
| 3126. | IAILT |
| 3127. | AILTG |
| 3128. | ILTGG |

TABLE 6-continued

| | |
|---|---|
| 3129. | LTGGQ |
| 3130. | TGGQL |
| 3131. | GGQLI |
| 3132. | GQLIS |
| 3133. | QLISE |
| 3134. | LISEE |
| 3135. | ISEEL |
| 3136. | SEELG |
| 3137. | EELGM |
| 3138. | ELGMK |
| 3139. | LGMKL |
| 3140. | GMKLE |
| 3141. | MKLEN |
| 3142. | KLENA |
| 3143. | LENAN |
| 3144. | ENANL |
| 3145. | NANLA |
| 3146. | ANLAM |
| 3147. | NLAML |
| 3148. | LAMLG |
| 3149. | AMLGK |
| 3150. | MLGKA |
| 3151. | LGKAK |
| 3152. | GKAKK |
| 3153. | KAKKV |
| 3154. | AKKVI |
| 3155. | KKVIV |
| 3156. | KVIVS |
| 3157. | VIVSK |
| 3158. | IVSKE |
| 3159. | VSKED |
| 3160. | SKEDT |
| 3161. | KEDTT |
| 3162. | EDTTI |
| 3163. | DTTIV |
| 3164. | TTIVE |
| 3165. | TIVEG |
| 3166. | IVEGM |
| 3167. | VEGMG |
| 3168. | EGMGE |
| 3169. | GMGEK |
| 3170. | MGEKE |
| 3171. | GEKEA |
| 3172. | EKEAL |
| 3173. | KEALE |
| 3174. | EALEA |
| 3175. | ALEAR |
| 3176. | LEARC |
| 3177. | EARCE |
| 3178. | ARCES |
| 3179. | RCESI |
| 3180. | CESIK |
| 3181. | ESIKK |
| 3182. | SIKKQ |
| 3183. | IKKQI |
| 3184. | KKQIE |
| 3185. | KQIED |
| 3186. | QIEDS |
| 3187. | IEDSS |
| 3188. | EDSSS |
| 3189. | DSSSD |
| 3190. | SSSDY |
| 3191. | SSDYD |
| 3192. | SDYDK |
| 3193. | DYDKE |
| 3194. | YDKEK |
| 3195. | DKEKL |
| 3196. | KEKLQ |
| 3197. | EKLQE |
| 3198. | KLQER |
| 3199. | LQERL |
| 3200. | QERLA |
| 3201. | ERLAK |
| 3202. | RLAKL |
| 3203. | LAKLS |
| 3204. | AKLSG |
| 3205. | KLSGG |
| 3206. | LSGGV |
| 3207. | SGGVA |
| 3208. | GGVAV |
| 3209. | GVAVI |
| 3210. | VAVIR |
| 3211. | AVIRV |
| 3212. | VIRVG |
| 3213. | IRVGA |
| 3214. | RVGAA |
| 3215. | VGAAT |
| 3216. | GAATE |
| 3217. | AATEI |
| 3218. | ATEIE |
| 3219. | TEIEM |
| 3220. | EIEMK |
| 3221. | IEMKE |
| 3222. | EMKEK |
| 3223. | MKEKK |
| 3224. | KEKKD |
| 3225. | EKKDR |
| 3226. | KKDRV |
| 3227. | KDRVD |
| 3228. | DRVDD |
| 3229. | RVDDA |
| 3230. | VDDAQ |
| 3231. | DDAQH |
| 3232. | DAQHA |
| 3233. | AQHAT |
| 3234. | QHATI |
| 3235. | HATIA |
| 3236. | ATIAA |
| 3237. | TIAAV |
| 3238. | IAAVE |
| 3239. | AAVEE |
| 3240. | AVEEG |
| 3241. | VEEGI |
| 3242. | EEGIL |
| 3243. | EGILP |
| 3244. | GILPG |
| 3245. | ILPGG |
| 3246. | LPGGG |
| 3247. | PGGGT |
| 3248. | GGGTA |
| 3249. | GGTAL |
| 3250. | GTALI |
| 3251. | TALIR |
| 3252. | ALIRC |
| 3253. | LIRCI |
| 3254. | IRCIP |
| 3255. | RCIPT |
| 3256. | CIPTL |
| 3257. | IPTLE |
| 3258. | PTLEA |
| 3259. | TLEAF |
| 3260. | LEAFL |
| 3261. | EAFLP |
| 3262. | AFLPM |
| 3263. | FLPML |
| 3264. | LPMLT |
| 3265. | PMLTN |
| 3266. | MLTNE |
| 3267. | LTNED |
| 3268. | TNEDE |
| 3269. | NEDEQ |
| 3270. | EDEQI |
| 3271. | DEQIG |
| 3272. | EQIGA |
| 3273. | QIGAR |
| 3274. | IGARI |
| 3275. | GARIV |
| 3276. | ARIVL |
| 3277. | RIVLK |
| 3278. | IVLKA |
| 3279. | VLKAL |
| 3280. | LKALS |
| 3281. | KALSA |
| 3282. | ALSAP |
| 3283. | LSAPL |
| 3284. | SAPLK |
| 3285. | APLKQ |
| 3286. | PLKQI |
| 3287. | LKQIA |
| 3288. | KQIAA |

TABLE 6-continued

| | |
|---|---|
| 3289. | QIAAN |
| 3290. | IAANA |
| 3291. | AANAG |
| 3292. | ANAGK |
| 3293. | NAGKE |
| 3294. | AGKEG |
| 3295. | GKEGA |
| 3296. | KEGAI |
| 3297. | EGAII |
| 3298. | GAIIF |
| 3299. | AIIFQ |
| 3300. | IIFQQ |
| 3301. | IFQQV |
| 3302. | FQQVM |
| 3303. | QQVMS |
| 3304. | QVMSR |
| 3305. | VMSRS |
| 3306. | MSRSA |
| 3307. | SRSAN |
| 3308. | RSANE |
| 3309. | SANEG |
| 3310. | ANEGY |
| 3311. | NEGYD |
| 3312. | EGYDA |
| 3313. | GYDAL |
| 3314. | YDALR |
| 3315. | DALRD |
| 3316. | ALRDA |
| 3317. | LRDAY |
| 3318. | RDAYT |
| 3319. | DAYTD |
| 3320. | AYTDM |
| 3321. | YTDML |
| 3322. | TDMLE |
| 3323. | DMLEA |
| 3324. | MLEAG |
| 3325. | LEAGI |
| 3326. | EAGIL |
| 3327. | AGILD |
| 3328. | GILDP |
| 3329. | ILDPA |
| 3330. | LDPAK |
| 3331. | DPAKV |
| 3332. | PAKVT |
| 3333. | AKVTR |
| 3334. | KVTRS |
| 3335. | VTRSA |
| 3336. | TRSAL |
| 3337. | RSALE |
| 3338. | SALES |
| 3339. | ALESA |
| 3340. | LESAA |
| 3341. | ESAAS |
| 3342. | SAASV |
| 3343. | AASVA |
| 3344. | ASVAG |
| 3345. | SVAGL |
| 3346. | VAGLL |
| 3347. | AGLLL |
| 3348. | GLLLT |
| 3349. | LLLTT |
| 3350. | LLTTE |
| 3351. | LTTEA |
| 3352. | TTEAL |
| 3353. | TEALI |
| 3354. | EALIA |
| 3355. | ALIAE |
| 3356. | LIAEI |
| 3357. | IAEIP |
| 3358. | AEIPE |
| 3359. | EIPEE |
| 3360. | IPEEK |
| 3361. | PEEKP |
| 3362. | EEKPA |
| 3363. | EKPAA |
| 3364. | KPAAA |
| 3365. | PAAAP |
| 3366. | AAAPA |
| 3367. | AAPAM |
| 3368. | APAMP |

TABLE 6-continued

| | |
|---|---|
| 3369. | PAMPG |
| 3370. | AMPGA |
| 3371. | MPGAG |
| 3372. | PGAGM |
| 3373. | GAGMD |
| 3374. | AGMDY |

5-mer peptides of CT376 (malate dehydrogenase, 326 amino acids) ACCESSION# NP 219885.1, GI: 15605100 (SEQ ID NOS: 3375-3696)

| | |
|---|---|
| 3375. | MVSQT |
| 3376. | VSQTV |
| 3377. | SQTVS |
| 3378. | QTVSV |
| 3379. | TVSVA |
| 3380. | VSVAV |
| 3381. | SVAVT |
| 3382. | VAVTG |
| 3383. | AVTGG |
| 3384. | VTGGT |
| 3385. | TGGTG |
| 3386. | GGTGQ |
| 3387. | GTGQI |
| 3388. | TGQIA |
| 3389. | GQIAY |
| 3390. | QIAYS |
| 3391. | IAYSF |
| 3392. | AYSFL |
| 3393. | YSFLF |
| 3394. | SFLFS |
| 3395. | FLFSL |
| 3396. | LFSLA |
| 3397. | FSLAH |
| 3398. | SLAHG |
| 3399. | LAHGD |
| 3400. | AHGDV |
| 3401. | HGDVF |
| 3402. | GDVFG |
| 3403. | DVFGL |
| 3404. | VFGLD |
| 3405. | FGLDC |
| 3406. | GLDCG |
| 3407. | LDCGI |
| 3408. | DCGID |
| 3409. | CGIDL |
| 3410. | GIDLR |
| 3411. | IDLRI |
| 3412. | DLRIY |
| 3413. | LRIYD |
| 3414. | RIYDI |
| 3415. | IYDIP |
| 3416. | YDIPG |
| 3417. | DIPGT |
| 3418. | IPGTE |
| 3419. | PGTER |
| 3420. | GTERA |
| 3421. | TERAL |
| 3422. | ERALS |
| 3423. | RALSG |
| 3424. | ALSGV |
| 3425. | LSGVR |
| 3426. | SGVRM |
| 3427. | GVRME |
| 3428. | VRMEL |
| 3429. | RMELD |
| 3430. | MELDD |
| 3431. | ELDDG |
| 3432. | LDDGA |
| 3433. | DDGAF |
| 3434. | DGAFP |
| 3435. | GAFPL |
| 3436. | AFPLL |
| 3437. | FPLLQ |
| 3438. | PLLQR |
| 3439. | LLQRV |
| 3440. | LQRVQ |
| 3441. | QRVQV |
| 3442. | RVQVT |
| 3443. | VQVTT |

TABLE 6-continued

| # | Seq |
|---|---|
| 3444. | QVTTS |
| 3445. | VTTSL |
| 3446. | TTSLH |
| 3447. | TSLHD |
| 3448. | SLHDA |
| 3449. | LHDAF |
| 3450. | HDAFD |
| 3451. | DAFDG |
| 3452. | AFDGI |
| 3453. | FDGID |
| 3454. | DGIDA |
| 3455. | GIDAA |
| 3456. | IDAAF |
| 3457. | DAAFL |
| 3458. | AAFLI |
| 3459. | AFLIG |
| 3460. | FLIGS |
| 3461. | LIGSV |
| 3462. | IGSVP |
| 3463. | GSVPR |
| 3464. | SVPRG |
| 3465. | VPRGP |
| 3466. | PRGPG |
| 3467. | RGPGM |
| 3468. | GPGME |
| 3469. | PGMER |
| 3470. | GMERR |
| 3471. | MERRD |
| 3472. | ERRDL |
| 3473. | RRDLL |
| 3474. | RDLLK |
| 3475. | DLLKK |
| 3476. | LLKKN |
| 3477. | LKKNG |
| 3478. | KKNGE |
| 3479. | KNGEI |
| 3480. | NGEIF |
| 3481. | GEIFA |
| 3482. | EIFAT |
| 3483. | IFATQ |
| 3484. | FATQG |
| 3485. | ATQGK |
| 3486. | TQGKA |
| 3487. | QGKAL |
| 3488. | GKALN |
| 3489. | KALNT |
| 3490. | ALNTT |
| 3491. | LNTTA |
| 3492. | NTTAK |
| 3493. | TTAKR |
| 3494. | TAKRD |
| 3495. | AKRDA |
| 3496. | KRDAK |
| 3497. | RDAKI |
| 3498. | DAKIF |
| 3499. | AKIFV |
| 3500. | KIFVV |
| 3501. | IFVVG |
| 3502. | FVVGN |
| 3503. | VVGNP |
| 3504. | VGNPV |
| 3505. | GNPVN |
| 3506. | NPVNT |
| 3507. | PVNTN |
| 3508. | VNTNC |
| 3509. | NTNCW |
| 3510. | TNCWI |
| 3511. | NCWIA |
| 3512. | CWIAM |
| 3513. | WIAMN |
| 3514. | IAMNH |
| 3515. | AMNHA |
| 3516. | MNHAP |
| 3517. | NHAPR |
| 3518. | HAPRL |
| 3519. | APRLL |
| 3520. | PRLLR |
| 3521. | RLLRK |
| 3522. | LLRKN |
| 3523. | LRKNF |
| 3524. | RKNFH |
| 3525. | KNFHA |
| 3526. | NFHAM |
| 3527. | FHAML |
| 3528. | HAMLR |
| 3529. | AMLRL |
| 3530. | MLRLD |
| 3531. | LRLDQ |
| 3532. | RLDQN |
| 3533. | LDQNR |
| 3534. | DQNRM |
| 3535. | QNRMH |
| 3536. | NRMHS |
| 3537. | RMHSM |
| 3538. | MHSML |
| 3539. | HSMLS |
| 3540. | SMLSH |
| 3541. | MLSHR |
| 3542. | LSHRA |
| 3543. | SHRAE |
| 3544. | HRAEV |
| 3545. | RAEVP |
| 3546. | AEVPL |
| 3547. | EVPLS |
| 3548. | VPLSA |
| 3549. | PLSAV |
| 3550. | LSAVS |
| 3551. | SAVSQ |
| 3552. | AVSQV |
| 3553. | VSQVV |
| 3554. | SQVVV |
| 3555. | QVVVW |
| 3556. | VVVWG |
| 3557. | VVWGN |
| 3558. | VWGNH |
| 3559. | WGNHS |
| 3560. | GNHSA |
| 3561. | NHSAK |
| 3562. | HSAKQ |
| 3563. | SAKQV |
| 3564. | AKQVP |
| 3565. | KQVPD |
| 3566. | QVPDF |
| 3567. | VPDFT |
| 3568. | PDFTQ |
| 3569. | DFTQA |
| 3570. | FTQAL |
| 3571. | TQALI |
| 3572. | QALIN |
| 3573. | ALIND |
| 3574. | LINDR |
| 3575. | INDRP |
| 3576. | NDRPI |
| 3577. | DRPIA |
| 3578. | RPIAE |
| 3579. | PIAET |
| 3580. | IAETI |
| 3581. | AETIA |
| 3582. | ETIAD |
| 3583. | TIADR |
| 3584. | IADRD |
| 3585. | ADRDW |
| 3586. | DRDWL |
| 3587. | RDWLE |
| 3588. | DWLEN |
| 3589. | WLENI |
| 3590. | LENIM |
| 3591. | ENIMV |
| 3592. | NIMVP |
| 3593. | IMVPS |
| 3594. | MVPSV |
| 3595. | VPSVQ |
| 3596. | PSVQS |
| 3597. | SVQSR |
| 3598. | VQSRG |
| 3599. | QSRGS |
| 3600. | SRGSA |
| 3601. | RGSAV |
| 3602. | GSAVI |
| 3603. | SAVIE |

TABLE 6-continued

| | |
|---|---|
| 3604. | AVIEA |
| 3605. | VIEAR |
| 3606. | IEARG |
| 3607. | EARGK |
| 3608. | ARGKS |
| 3609. | RGKSS |
| 3610. | GKSSA |
| 3611. | KSSAA |
| 3612. | SSAAS |
| 3613. | SAASA |
| 3614. | AASAA |
| 3615. | ASAAR |
| 3616. | SAARA |
| 3617. | AARAL |
| 3618. | ARALA |
| 3619. | RALAE |
| 3620. | ALAEA |
| 3621. | LAEAA |
| 3622. | AEAAR |
| 3623. | EAARS |
| 3624. | AARSI |
| 3625. | ARSIY |
| 3626. | RSIYQ |
| 3627. | SIYQP |
| 3628. | IYQPK |
| 3629. | YQPKE |
| 3630. | QPKEG |
| 3631. | PKEGE |
| 3632. | KEGEW |
| 3633. | EGEWF |
| 3634. | GEWFS |
| 3635. | EWFSS |
| 3636. | WFSSG |
| 3637. | FSSGV |
| 3638. | SSGVC |
| 3639. | SGVCS |
| 3640. | GVCSD |
| 3641. | VCSDH |
| 3642. | CSDHN |
| 3643. | SDHNP |
| 3644. | DHNPY |
| 3645. | HNPYG |
| 3646. | NPYGL |
| 3647. | PYGLP |
| 3648. | YGLPE |
| 3649. | GLPED |
| 3650. | LPEDL |
| 3651. | PEDLI |
| 3652. | EDLIF |
| 3653. | DLIFG |
| 3654. | LIFGF |
| 3655. | IFGFP |
| 3656. | FGFPC |
| 3657. | GFPCR |
| 3658. | FPCRM |
| 3659. | PCRML |
| 3660. | CRMLA |
| 3661. | RMLAT |
| 3662. | MLATG |
| 3663. | LATGE |
| 3664. | ATGEY |
| 3665. | TGEYE |
| 3666. | GEYEV |
| 3667. | EYEVI |
| 3668. | YEVIP |
| 3669. | EVIPR |
| 3670. | VIPRL |
| 3671. | IPRLP |
| 3672. | PRLPW |
| 3673. | RLPWD |
| 3674. | LPWDA |
| 3675. | PWDAF |
| 3676. | WDAFI |
| 3677. | DAFIR |
| 3678. | AFIRG |
| 3679. | FIRGK |
| 3680. | IRGKM |
| 3681. | RGKMQ |
| 3682. | GKMQI |
| 3683. | KMQIS |

TABLE 6-continued

| | |
|---|---|
| 3684. | MQISL |
| 3685. | QISLD |
| 3686. | ISLDE |
| 3687. | SLDEI |
| 3688. | LDEIL |
| 3689. | DEILQ |
| 3690. | EILQE |
| 3691. | ILQEK |
| 3692. | LQEKA |
| 3693. | QEKAS |
| 3694. | EKASV |
| 3695. | KASVS |
| 3696. | ASVSL |

5-mer peptides of CT557 (dihydrolipoamide dehydrogenase, 465 amino acids), ACCESSION# NP 220072.1, GI: 15605286 (SEQ ID NOS: 3697-4018)

| | |
|---|---|
| 3697. | MVSQT |
| 3698. | VSQTV |
| 3699. | SQTVS |
| 3700. | QTVSV |
| 3701. | TVSVA |
| 3702. | VSVAV |
| 3703. | SVAVT |
| 3704. | VAVTG |
| 3705. | AVTGG |
| 3706. | VTGGT |
| 3707. | TGGTG |
| 3708. | GGTGQ |
| 3709. | GTGQI |
| 3710. | TGQIA |
| 3711. | GQIAY |
| 3712. | QIAYS |
| 3713. | IAYSF |
| 3714. | AYSFL |
| 3715. | YSFLF |
| 3716. | SFLFS |
| 3717. | FLFSL |
| 3718. | LFSLA |
| 3719. | FSLAH |
| 3720. | SLAHG |
| 3721. | LAHGD |
| 3722. | AHGDV |
| 3723. | HGDVF |
| 3724. | GDVFG |
| 3725. | DVFGL |
| 3726. | VFGLD |
| 3727. | FGLDC |
| 3728. | GLDCG |
| 3729. | LDCGI |
| 3730. | DCGID |
| 3731. | CGIDL |
| 3732. | GIDLR |
| 3733. | IDLRI |
| 3734. | DLRIY |
| 3735. | LRIYD |
| 3736. | RIYDI |
| 3737. | IYDIP |
| 3738. | YDIPG |
| 3739. | DIPGT |
| 3740. | IPGTE |
| 3741. | PGTER |
| 3742. | GTERA |
| 3743. | TERAL |
| 3744. | ERALS |
| 3745. | RALSG |
| 3746. | ALSGV |
| 3747. | LSGVR |
| 3748. | SGVRM |
| 3749. | GVRME |
| 3750. | VRMEL |
| 3751. | RMELD |
| 3752. | MELDD |
| 3753. | ELDDG |
| 3754. | LDDGA |
| 3755. | DDGAF |
| 3756. | DGAFP |
| 3757. | GAFPL |
| 3758. | AFPLL |

TABLE 6-continued

| | |
|---|---|
| 3759. | FPLLQ |
| 3760. | PLLQR |
| 3761. | LLQRV |
| 3762. | LQRVQ |
| 3763. | QRVQV |
| 3764. | RVQVT |
| 3765. | VQVTT |
| 3766. | QVTTS |
| 3767. | VTTSL |
| 3768. | TTSLH |
| 3769. | TSLHD |
| 3770. | SLHDA |
| 3771. | LHDAF |
| 3772. | HDAFD |
| 3773. | DAFDG |
| 3774. | AFDGI |
| 3775. | FDGID |
| 3776. | DGIDA |
| 3777. | GIDAA |
| 3778. | IDAAF |
| 3779. | DAAFL |
| 3780. | AAFLI |
| 3781. | AFLIG |
| 3782. | FLIGS |
| 3783. | LIGSV |
| 3784. | IGSVP |
| 3785. | GSVPR |
| 3786. | SVPRG |
| 3787. | VPRGP |
| 3788. | PRGPG |
| 3789. | RGPGM |
| 3790. | GPGME |
| 3791. | PGMER |
| 3792. | GMERR |
| 3793. | MERRD |
| 3794. | ERRDL |
| 3795. | RRDLL |
| 3796. | RDLLK |
| 3797. | DLLKK |
| 3798. | LLKKN |
| 3799. | LKKNG |
| 3800. | KKNGE |
| 3801. | KNGEI |
| 3802. | NGEIF |
| 3803. | GEIFA |
| 3804. | EIFAT |
| 3805. | IFATQ |
| 3806. | FATQG |
| 3807. | ATQGK |
| 3808. | TQGKA |
| 3809. | QGKAL |
| 3810. | GKALN |
| 3811. | KALNT |
| 3812. | ALNTT |
| 3813. | LNTTA |
| 3814. | NTTAK |
| 3815. | TTAKR |
| 3816. | TAKRD |
| 3817. | AKRDA |
| 3818. | KRDAK |
| 3819. | RDAKI |
| 3820. | DAKIF |
| 3821. | AKIFV |
| 3822. | KIFVV |
| 3823. | IFVVG |
| 3824. | FVVGN |
| 3825. | VVGNP |
| 3826. | VGNPV |
| 3827. | GNPVN |
| 3828. | NPVNT |
| 3829. | PVNTN |
| 3830. | VNTNC |
| 3831. | NTNCW |
| 3832. | TNCWI |
| 3833. | NCWIA |
| 3834. | CWIAM |
| 3835. | WIAMN |
| 3836. | IAMNH |
| 3837. | AMNHA |
| 3838. | MNHAP |
| 3839. | NHAPR |
| 3840. | HAPRL |
| 3841. | APRLL |
| 3842. | PRLLR |
| 3843. | RLLRK |
| 3844. | LLRKN |
| 3845. | LRKNF |
| 3846. | RKNFH |
| 3847. | KNFHA |
| 3848. | NFHAM |
| 3849. | FHAML |
| 3850. | HAMLR |
| 3851. | AMLRL |
| 3852. | MLRLD |
| 3853. | LRLDQ |
| 3854. | RLDQN |
| 3855. | LDQNR |
| 3856. | DQNRM |
| 3857. | QNRMH |
| 3858. | NRMHS |
| 3859. | RMHSM |
| 3860. | MHSML |
| 3861. | HSMLS |
| 3862. | SMLSH |
| 3863. | MLSHR |
| 3864. | LSHRA |
| 3865. | SHRAE |
| 3866. | HRAEV |
| 3867. | RAEVP |
| 3868. | AEVPL |
| 3869. | EVPLS |
| 3870. | VPLSA |
| 3871. | PLSAV |
| 3872. | LSAVS |
| 3873. | SAVSQ |
| 3874. | AVSQV |
| 3875. | VSQVV |
| 3876. | SQVVV |
| 3877. | QVVVW |
| 3878. | VVVWG |
| 3879. | VVWGN |
| 3880. | VWGNH |
| 3881. | WGNHS |
| 3882. | GNHSA |
| 3883. | NHSAK |
| 3884. | HSAKQ |
| 3885. | SAKQV |
| 3886. | AKQVP |
| 3887. | KQVPD |
| 3888. | QVPDF |
| 3889. | VPDFT |
| 3890. | PDFTQ |
| 3891. | DFTQA |
| 3892. | FTQAL |
| 3893. | TQALI |
| 3894. | QALIN |
| 3895. | ALIND |
| 3896. | LINDR |
| 3897. | INDRP |
| 3898. | NDRPI |
| 3899. | DRPIA |
| 3900. | RPIAE |
| 3901. | PIAET |
| 3902. | IAETI |
| 3903. | AETIA |
| 3904. | ETIAD |
| 3905. | TIADR |
| 3906. | IADRD |
| 3907. | ADRDW |
| 3908. | DRDWL |
| 3909. | RDWLE |
| 3910. | DWLEN |
| 3911. | WLENI |
| 3912. | LENIM |
| 3913. | ENIMV |
| 3914. | NIMVP |
| 3915. | IMVPS |
| 3916. | MVPSV |
| 3917. | VPSVQ |
| 3918. | PSVQS |

TABLE 6-continued

| | |
|---|---|
| 3919. | SVQSR |
| 3920. | VQSRG |
| 3921. | QSRGS |
| 3922. | SRGSA |
| 3923. | RGSAV |
| 3924. | GSAVI |
| 3925. | SAVIE |
| 3926. | AVIEA |
| 3927. | VIEAR |
| 3928. | IEARG |
| 3929. | EARGK |
| 3930. | ARGKS |
| 3931. | RGKSS |
| 3932. | GKSSA |
| 3933. | KSSAA |
| 3934. | SSAAS |
| 3935. | SAASA |
| 3936. | AASAA |
| 3937. | ASAAR |
| 3938. | SAARA |
| 3939. | AARAL |
| 3940. | ARALA |
| 3941. | RALAE |
| 3942. | ALAEA |
| 3943. | LAEAA |
| 3944. | AEAAR |
| 3945. | EAARS |
| 3946. | AARSI |
| 3947. | ARSIY |
| 3948. | RSIYQ |
| 3949. | SIYQP |
| 3950. | IYQPK |
| 3951. | YQPKE |
| 3952. | QPKEG |
| 3953. | PKEGE |
| 3954. | KEGEW |
| 3955. | EGEWF |
| 3956. | GEWFS |
| 3957. | EWFSS |
| 3958. | WFSSG |
| 3959. | FSSGV |
| 3960. | SSGVC |
| 3961. | SGVCS |
| 3962. | GVCSD |
| 3963. | VCSDH |
| 3964. | CSDHN |
| 3965. | SDHNP |
| 3966. | DHNPY |
| 3967. | HNPYG |
| 3968. | NPYGL |
| 3969. | PYGLP |
| 3970. | YGLPE |
| 3971. | GLPED |
| 3972. | LPEDL |
| 3973. | PEDLI |
| 3974. | EDLIF |
| 3975. | DLIFG |
| 3976. | LIFGF |
| 3977. | IFGFP |
| 3978. | FGFPC |
| 3979. | GFPCR |
| 3980. | FPCRM |
| 3981. | PCRML |
| 3982. | CRMLA |
| 3983. | RMLAT |
| 3984. | MLATG |
| 3985. | LATGE |
| 3986. | ATGEY |
| 3987. | TGEYE |
| 3988. | GEYEV |
| 3989. | EYEVI |
| 3990. | YEVIP |
| 3991. | EVIPR |
| 3992. | VIPRL |
| 3993. | IPRLP |
| 3994. | PRLPW |
| 3995. | RLPWD |
| 3996. | LPWDA |
| 3997. | PWDAF |
| 3998. | WDAFI |

TABLE 6-continued

| | |
|---|---|
| 3999. | DAFIR |
| 4000. | AFIRG |
| 4001. | FIRGK |
| 4002. | IRGKM |
| 4003. | RGKMQ |
| 4004. | GKMQI |
| 4005. | KMQIS |
| 4006. | MQISL |
| 4007. | QISLD |
| 4008. | ISLDE |
| 4009. | SLDEI |
| 4010. | LDEIL |
| 4011. | DEILQ |
| 4012. | EILQE |
| 4013. | ILQEK |
| 4014. | LQEKA |
| 4015. | QEKAS |
| 4016. | EKASV |
| 4017. | KASVS |
| 4018. | ASVSL |

5-mer peptides of CT858 (CPAF, total of 609 amino acids), ACCESSION# AAC68456.1, GI: 3329332 (SEQ ID NOS: 4019-4623)

| | |
|---|---|
| 4019. | MGFWR |
| 4020. | GFWRT |
| 4021. | FWRTS |
| 4022. | WRTSI |
| 4023. | RTSIM |
| 4024. | TSIMK |
| 4025. | SIMKM |
| 4026. | IMKMN |
| 4027. | MKMNR |
| 4028. | KMNRI |
| 4029. | MNRIW |
| 4030. | NRIWL |
| 4031. | RIWLL |
| 4032. | IWLLL |
| 4033. | WLLLL |
| 4034. | LLLLT |
| 4035. | LLLTF |
| 4036. | LLTFS |
| 4037. | LTFSS |
| 4038. | TFSSA |
| 4039. | FSSAI |
| 4040. | SSAIH |
| 4041. | SAIHS |
| 4042. | AIHSP |
| 4043. | IHSPV |
| 4044. | HSPVQ |
| 4045. | SPVQG |
| 4046. | PVQGE |
| 4047. | VQGES |
| 4048. | QGESL |
| 4049. | GESLV |
| 4050. | ESLVC |
| 4051. | SLVCK |
| 4052. | LVCKN |
| 4053. | VCKNA |
| 4054. | CKNAL |
| 4055. | KNALQ |
| 4056. | NALQD |
| 4057. | ALQDL |
| 4058. | LQDLS |
| 4059. | QDLSF |
| 4060. | DLSFL |
| 4061. | LSFLE |
| 4062. | SFLEH |
| 4063. | FLEHL |
| 4064. | LEHLL |
| 4065. | EHLLQ |
| 4066. | HLLQV |
| 4067. | LLQVK |
| 4068. | LQVKY |
| 4069. | QVKYA |
| 4070. | VKYAP |
| 4071. | KYAPK |
| 4072. | YAPKT |
| 4073. | APKTW |

TABLE 6-continued

| | |
|---|---|
| 4074. | PKTWK |
| 4075. | KTWKE |
| 4076. | TWKEQ |
| 4077. | WKEQY |
| 4078. | KEQYL |
| 4079. | EQYLG |
| 4080. | QYLGW |
| 4081. | YLGWD |
| 4082. | LGWDL |
| 4083. | GWDLV |
| 4084. | WDLVQ |
| 4085. | DLVQS |
| 4086. | LVQSS |
| 4087. | VQSSV |
| 4088. | QSSVS |
| 4089. | SSVSA |
| 4090. | SVSAQ |
| 4091. | VSAQQ |
| 4092. | SAQQK |
| 4093. | AQQKL |
| 4094. | QQKLR |
| 4095. | QKLRT |
| 4096. | KLRTQ |
| 4097. | LRTQE |
| 4098. | RTQEN |
| 4099. | TQENP |
| 4100. | QENPS |
| 4101. | ENPST |
| 4102. | NPSTS |
| 4103. | PSTSF |
| 4104. | STSFC |
| 4105. | TSFCQ |
| 4106. | SFCQQ |
| 4107. | FCQQV |
| 4108. | CQQVL |
| 4109. | QQVLA |
| 4110. | QVLAD |
| 4111. | VLADF |
| 4112. | LADFI |
| 4113. | ADFIG |
| 4114. | DFIGG |
| 4115. | FIGGL |
| 4116. | IGGLN |
| 4117. | GGLND |
| 4118. | GLNDF |
| 4119. | LNDFH |
| 4120. | NDFHA |
| 4121. | DFHAG |
| 4122. | FHAGV |
| 4123. | HAGVT |
| 4124. | AGVTF |
| 4125. | GVTFF |
| 4126. | VTFFA |
| 4127. | TFFAI |
| 4128. | FFAIE |
| 4129. | FAIES |
| 4130. | AIESA |
| 4131. | IESAY |
| 4132. | ESAYL |
| 4133. | SAYLP |
| 4134. | AYLPY |
| 4135. | YLPYT |
| 4136. | LPYTV |
| 4137. | PYTVQ |
| 4138. | YTVQK |
| 4139. | TVQKS |
| 4140. | VQKSS |
| 4141. | QKSSD |
| 4142. | KSSDG |
| 4143. | SSDGR |
| 4144. | SDGRF |
| 4145. | DGRFY |
| 4146. | GRFYF |
| 4147. | RFYFV |
| 4148. | FYFVD |
| 4149. | YFVDI |
| 4150. | FVDIM |
| 4151. | VDIMT |
| 4152. | DIMTF |
| 4153. | IMTFS |
| 4154. | MTFSS |
| 4155. | TFSSE |
| 4156. | FSSEI |
| 4157. | SSEIR |
| 4158. | SEIRV |
| 4159. | EIRVG |
| 4160. | IRVGD |
| 4161. | RVGDE |
| 4162. | VGDEL |
| 4163. | GDELL |
| 4164. | DELLE |
| 4165. | ELLEV |
| 4166. | LLEVD |
| 4167. | LEVDG |
| 4168. | EVDGA |
| 4169. | VDGAP |
| 4170. | DGAPV |
| 4171. | GAPVQ |
| 4172. | APVQD |
| 4173. | PVQDV |
| 4174. | VQDVL |
| 4175. | QDVLA |
| 4176. | DVLAT |
| 4177. | VLATL |
| 4178. | LATLY |
| 4179. | ATLYG |
| 4180. | TLYGS |
| 4181. | LYGSN |
| 4182. | YGSNH |
| 4183. | GSNHK |
| 4184. | SNHKG |
| 4185. | NHKGT |
| 4186. | HKGTA |
| 4187. | KGTAA |
| 4188. | GTAAE |
| 4189. | TAAEE |
| 4190. | AAEES |
| 4191. | AEESA |
| 4192. | EESAA |
| 4193. | ESAAL |
| 4194. | SAALR |
| 4195. | AALRT |
| 4196. | ALRTL |
| 4197. | LRTLF |
| 4198. | RTLFS |
| 4199. | TLFSR |
| 4200. | LFSRM |
| 4201. | FSRMA |
| 4202. | SRMAS |
| 4203. | RMASL |
| 4204. | MASLG |
| 4205. | ASLGH |
| 4206. | SLGHK |
| 4207. | LGHKV |
| 4208. | GHKVP |
| 4209. | HKVPS |
| 4210. | KVPSG |
| 4211. | VPSGR |
| 4212. | PSGRT |
| 4213. | SGRTT |
| 4214. | GRTTL |
| 4215. | RTTLK |
| 4216. | TTLKI |
| 4217. | TLKIR |
| 4218. | LKIRR |
| 4219. | KIRRP |
| 4220. | IRRPF |
| 4221. | RRPFG |
| 4222. | RPFGT |
| 4223. | PFGTT |
| 4224. | FGTTR |
| 4225. | GTTRE |
| 4226. | TTREV |
| 4227. | TREVR |
| 4228. | REVRV |
| 4229. | EVRVK |
| 4230. | VRVKW |
| 4231. | RVKWR |
| 4232. | VKWRY |
| 4233. | KWRYV |

TABLE 6-continued

| | |
|---|---|
| 4234. | WRYVP |
| 4235. | RYVPE |
| 4236. | YVPEG |
| 4237. | VPEGV |
| 4238. | PEGVG |
| 4239. | EGVGD |
| 4240. | GVGDL |
| 4241. | VGDLA |
| 4242. | GDLAT |
| 4243. | DLATI |
| 4244. | LATIA |
| 4245. | ATIAP |
| 4246. | TIAPS |
| 4247. | IAPSI |
| 4248. | APSIR |
| 4249. | PSIRA |
| 4250. | SIRAP |
| 4251. | IRAPQ |
| 4252. | RAPQL |
| 4253. | APQLQ |
| 4254. | PQLQK |
| 4255. | QLQKS |
| 4256. | LQKSM |
| 4257. | QKSMR |
| 4258. | KSMRS |
| 4259. | SMRSF |
| 4260. | MRSFF |
| 4261. | RSFFP |
| 4262. | SFFPK |
| 4263. | FFPKK |
| 4264. | FPKKD |
| 4265. | PKKDD |
| 4266. | KKDDA |
| 4267. | KDDAF |
| 4268. | DDAFH |
| 4269. | DAFHR |
| 4270. | AFHRS |
| 4271. | FHRSS |
| 4272. | HRSSS |
| 4273. | RSSSL |
| 4274. | SSSLF |
| 4275. | SSLFY |
| 4276. | SLFYS |
| 4277. | LFYSP |
| 4278. | FYSPM |
| 4279. | YSPMV |
| 4280. | SPMVP |
| 4281. | PMVPH |
| 4282. | MVPHF |
| 4283. | VPHFW |
| 4284. | PHFWA |
| 4285. | HFWAE |
| 4286. | FWAEL |
| 4287. | WAELR |
| 4288. | AELRN |
| 4289. | ELRNH |
| 4290. | LRNHY |
| 4291. | RNHYA |
| 4292. | NHYAT |
| 4293. | HYATS |
| 4294. | YATSG |
| 4295. | ATSGL |
| 4296. | TSGLK |
| 4297. | SGLKS |
| 4298. | GLKSG |
| 4299. | LKSGY |
| 4300. | KSGYN |
| 4301. | SGYNI |
| 4302. | GYNIG |
| 4303. | YNIGS |
| 4304. | NIGST |
| 4305. | IGSTD |
| 4306. | GSTDG |
| 4307. | STDGF |
| 4308. | TDGFL |
| 4309. | DGFLP |
| 4310. | GFLPV |
| 4311. | FLPVI |
| 4312. | LPVIG |
| 4313. | PVIGP |

TABLE 6-continued

| | |
|---|---|
| 4314. | VIGPV |
| 4315. | IGPVI |
| 4316. | GPVIW |
| 4317. | PVIWE |
| 4318. | VIWES |
| 4319. | IWESE |
| 4320. | WESEG |
| 4321. | ESEGL |
| 4322. | SEGLF |
| 4323. | EGLFR |
| 4324. | GLFRA |
| 4325. | LFRAY |
| 4326. | FRAYI |
| 4327. | RAYIS |
| 4328. | AYISS |
| 4329. | YISSV |
| 4330. | ISSVT |
| 4331. | SSVTD |
| 4332. | SVTDG |
| 4333. | VTDGD |
| 4334. | TDGDG |
| 4335. | DGDGK |
| 4336. | GDGKS |
| 4337. | DGKSH |
| 4338. | GKSHK |
| 4339. | KSHKV |
| 4340. | SHKVG |
| 4341. | HKVGF |
| 4342. | KVGFL |
| 4343. | VGFLR |
| 4344. | GFLRI |
| 4345. | FLRIP |
| 4346. | LRIPT |
| 4347. | RIPTY |
| 4348. | IPTYS |
| 4349. | PTYSW |
| 4350. | TYSWQ |
| 4351. | YSWQD |
| 4352. | SWQDM |
| 4353. | WQDME |
| 4354. | QDMED |
| 4355. | DMEDF |
| 4356. | MEDFD |
| 4357. | EDFDP |
| 4358. | DFDPS |
| 4359. | FDPSG |
| 4360. | DPSGP |
| 4361. | PSGPP |
| 4362. | SGPPP |
| 4363. | GPPPW |
| 4364. | PPPWE |
| 4365. | PPWEE |
| 4366. | PWEEF |
| 4367. | WEEFA |
| 4368. | EEFAK |
| 4369. | EFAKI |
| 4370. | FAKII |
| 4371. | AKIIQ |
| 4372. | KIIQV |
| 4373. | IIQVF |
| 4374. | IQVFS |
| 4375. | QVFSS |
| 4376. | VFSSN |
| 4377. | FSSNT |
| 4378. | SSNTE |
| 4379. | SNTEA |
| 4380. | NTEAL |
| 4381. | TEALI |
| 4382. | EALII |
| 4383. | ALIID |
| 4384. | LIIDQ |
| 4385. | IIDQT |
| 4386. | IDQTN |
| 4387. | DQTNN |
| 4388. | QTNNP |
| 4389. | TNNPG |
| 4390. | NNPGG |
| 4391. | NPGGS |
| 4392. | PGGSV |
| 4393. | GGSVL |

TABLE 6-continued

| | | |
|---|---|---|
| 4394. | GSVLY | |
| 4395. | SVLYL | |
| 4396. | VLYLY | |
| 4397. | LYLYA | |
| 4398. | YLYAL | |
| 4399. | LYALL | |
| 4400. | YALLS | |
| 4401. | ALLSM | |
| 4402. | LLSML | |
| 4403. | LSMLT | |
| 4404. | SMLTD | |
| 4405. | MLTDR | |
| 4406. | LTDRP | |
| 4407. | TDRPL | |
| 4408. | DRPLE | |
| 4409. | RPLEL | |
| 4410. | PLELP | |
| 4411. | LELPK | |
| 4412. | ELPKH | |
| 4413. | LPKHR | |
| 4414. | PKHRM | |
| 4415. | KHRMI | |
| 4416. | HRMIL | |
| 4417. | RMILT | |
| 4418. | MILTQ | |
| 4419. | ILTQD | |
| 4420. | LTQDE | |
| 4421. | TQDEV | |
| 4422. | QDEVV | |
| 4423. | DEVVD | |
| 4424. | EVVDA | |
| 4425. | VVDAL | |
| 4426. | VDALD | |
| 4427. | DALDW | |
| 4428. | ALDWL | |
| 4429. | LDWLT | |
| 4430. | DWLTL | |
| 4431. | WLTLL | |
| 4432. | LTLLE | |
| 4433. | TLLEN | |
| 4434. | LLENV | |
| 4435. | LENVD | |
| 4436. | ENVDT | |
| 4437. | NVDTN | |
| 4438. | VDTNV | |
| 4439. | DTNVE | |
| 4440. | TNVES | |
| 4441. | NVESR | |
| 4442. | VESRL | |
| 4443. | ESRLA | |
| 4444. | SRLAL | |
| 4445. | RLALG | |
| 4446. | LALGD | |
| 4447. | ALGDN | |
| 4448. | LGDNM | |
| 4449. | GDNME | |
| 4450. | DNMEG | |
| 4451. | NMEGY | |
| 4452. | MEGYT | |
| 4453. | EGYTV | |
| 4454. | GYTVD | |
| 4455. | YTVDL | |
| 4456. | TVDLQ | |
| 4457. | VDLQV | |
| 4458. | DLQVA | |
| 4459. | LQVAE | |
| 4460. | QVAEY | |
| 4461. | VAEYL | |
| 4462. | AEYLK | |
| 4463. | EYLKS | |
| 4464. | YLKSF | |
| 4465. | LKSFG | |
| 4466. | KSFGR | |
| 4467. | SFGRQ | |
| 4468. | FGRQV | |
| 4469. | GRQVL | |
| 4470. | RQVLN | |
| 4471. | QVLNC | |
| 4472. | VLNCW | |
| 4473. | LNCWS | |
| 4474. | NCWSK | |
| 4475. | CWSKG | |
| 4476. | WSKGD | |
| 4477. | SKGDI | |
| 4478. | KGDIE | |
| 4479. | GDIEL | |
| 4480. | DIELS | |
| 4481. | IELST | |
| 4482. | ELSTP | |
| 4483. | LSTPI | |
| 4484. | STPIP | |
| 4485. | TPIPL | |
| 4486. | PIPLF | |
| 4487. | IPLFG | |
| 4488. | PLFGF | |
| 4489. | LFGFE | |
| 4490. | FGFEK | |
| 4491. | GFEKI | |
| 4492. | FEKIH | |
| 4493. | EKIHP | |
| 4494. | KIHPH | |
| 4495. | IHPHP | |
| 4496. | HPHPR | |
| 4497. | PHPRV | |
| 4498. | HPRVQ | |
| 4499. | PRVQY | |
| 4500. | RVQYS | |
| 4501. | VQYSK | |
| 4502. | QYSKP | |
| 4503. | YSKPI | |
| 4504. | SKPIC | |
| 4505. | KPICV | |
| 4506. | PICVL | |
| 4507. | ICVLI | |
| 4508. | CVLIN | |
| 4509. | VLINE | |
| 4510. | LINEQ | |
| 4511. | INEQD | |
| 4512. | NEQDF | |
| 4513. | EQDFS | |
| 4514. | QDFSC | |
| 4515. | DFSCA | |
| 4516. | FSCAD | |
| 4517. | SCADF | |
| 4518. | CADFF | |
| 4519. | ADFFP | |
| 4520. | DFFPV | |
| 4521. | FFPVV | |
| 4522. | FPVVL | |
| 4523. | PVVLK | |
| 4524. | VVLKD | |
| 4525. | VLKDN | |
| 4526. | LKDND | |
| 4527. | KDNDR | |
| 4528. | DNDRA | |
| 4529. | NDRAL | |
| 4530. | DRALI | |
| 4531. | RALIV | |
| 4532. | ALIVG | |
| 4533. | LIVGT | |
| 4534. | IVGTR | |
| 4535. | VGTRT | |
| 4536. | GTRTA | |
| 4537. | TRTAG | |
| 4538. | RTAGA | |
| 4539. | TAGAG | |
| 4540. | AGAGG | |
| 4541. | GAGGF | |
| 4542. | AGGFV | |
| 4543. | GGFVF | |
| 4544. | GFVFN | |
| 4545. | FVFNV | |
| 4546. | VFNVQ | |
| 4547. | FNVQF | |
| 4548. | NVQFP | |
| 4549. | VQFPN | |
| 4550. | QFPNR | |
| 4551. | FPNRT | |
| 4552. | PNRTG | |
| 4553. | NRTGI | |

TABLE 6-continued

| | |
|---|---|
| 4554. | RTGIK |
| 4555. | TGIKT |
| 4556. | GIKTC |
| 4557. | IKTCS |
| 4558. | KTCSL |
| 4559. | TCSLT |
| 4560. | CSLTG |
| 4561. | SLTGS |
| 4562. | LTGSL |
| 4563. | TGSLA |
| 4564. | GSLAV |
| 4565. | SLAVR |
| 4566. | LAVRE |
| 4567. | AVREH |
| 4568. | VREHG |
| 4569. | REHGA |
| 4570. | EHGAF |
| 4571. | HGAFI |
| 4572. | GAFIE |
| 4573. | AFIEN |
| 4574. | FIENI |
| 4575. | IENIG |
| 4576. | ENIGV |
| 4577. | NIGVE |
| 4578. | IGVEP |
| 4579. | GVEPH |
| 4580. | VEPHI |
| 4581. | EPHID |
| 4582. | PHIDL |
| 4583. | HIDLP |
| 4584. | IDLPF |
| 4585. | DLPFT |
| 4586. | LPFTA |
| 4587. | PFTAN |
| 4588. | FTAND |
| 4589. | TANDI |
| 4590. | ANDIR |
| 4591. | NDIRY |
| 4592. | DIRYK |
| 4593. | IRYKG |
| 4594. | RYKGY |
| 4595. | YKGYS |
| 4596. | KGYSE |
| 4597. | GYSEY |
| 4598. | YSEYL |
| 4599. | SEYLD |
| 4600. | EYLDK |
| 4601. | YLDKV |
| 4602. | LDKVK |
| 4603. | DKVKK |
| 4604. | KVKKL |
| 4605. | VKKLV |
| 4606. | KKLVC |
| 4607. | KLVCQ |
| 4608. | LVCQL |
| 4609. | VCQLI |
| 4610. | CQLIN |
| 4611. | QLINN |
| 4612. | LINND |
| 4613. | INNDG |
| 4614. | NNDGT |
| 4615. | NDGTI |
| 4616. | DGTII |
| 4617. | GTIIL |
| 4618. | TIILA |
| 4619. | IILAE |
| 4620. | ILAED |
| 4621. | LAEDG |
| 4622. | AEDGS |
| 4623. | EDGSF |

5-mer peptides of Pgp3 (plasmid-encoded secretion protein, total of 264 amino acids), ACCESSION# ADI51551.1, GI: 297749006 (SEQ ID NOS: 4624-4883)

| | |
|---|---|
| 4624. | MGNSG |
| 4625. | GNSGF |
| 4626. | NSGFY |
| 4627. | SGFYL |
| 4628. | GFYLY |
| 4629. | FYLYN |
| 4630. | YLYNT |
| 4631. | LYNTE |
| 4632. | YNTEN |
| 4633. | NTENC |
| 4634. | TENCV |
| 4635. | ENCVF |
| 4636. | NCVFA |
| 4637. | CVFAD |
| 4638. | VFADN |
| 4639. | FADNI |
| 4640. | ADNIK |
| 4641. | DNIKV |
| 4642. | NIKVG |
| 4643. | IKVGQ |
| 4644. | KVGQM |
| 4645. | VGQMT |
| 4646. | GQMTE |
| 4647. | QMTEP |
| 4648. | MTEPL |
| 4649. | TEPLK |
| 4650. | EPLKD |
| 4651. | PLKDQ |
| 4652. | LKDQQ |
| 4653. | KDQQI |
| 4654. | DQQII |
| 4655. | QQIIL |
| 4656. | QIILG |
| 4657. | IILGT |
| 4658. | ILGTK |
| 4659. | LGTKS |
| 4660. | GTKST |
| 4661. | TKSTP |
| 4662. | KSTPV |
| 4663. | STPVA |
| 4664. | TPVAA |
| 4665. | PVAAK |
| 4666. | VAAKM |
| 4667. | AAKMT |
| 4668. | AKMTA |
| 4669. | KMTAS |
| 4670. | MTASD |
| 4671. | TASDG |
| 4672. | ASDGI |
| 4673. | SDGIS |
| 4674. | DGISL |
| 4675. | GISLT |
| 4676. | ISLTV |
| 4677. | SLTVS |
| 4678. | LTVSN |
| 4679. | TVSNN |
| 4680. | VSNNS |
| 4681. | SNNSS |
| 4682. | NNSST |
| 4683. | NSSTN |
| 4684. | SSTNA |
| 4685. | STNAS |
| 4686. | TNASI |
| 4687. | NASIT |
| 4688. | ASITI |
| 4689. | SITIG |
| 4690. | ITIGL |
| 4691. | TIGLD |
| 4692. | IGLDA |
| 4693. | GLDAE |
| 4694. | LDAEK |
| 4695. | DAEKA |
| 4696. | AEKAY |
| 4697. | EKAYQ |
| 4698. | KAYQL |
| 4699. | AYQLI |
| 4700. | YQLIL |
| 4701. | QLILE |
| 4702. | LILEK |
| 4703. | ILEKL |
| 4704. | LEKLG |
| 4705. | EKLGN |
| 4706. | KLGNQ |
| 4707. | LGNQI |
| 4708. | GNQIL |

TABLE 6-continued

| | |
|---|---|
| 4709. | NQILD |
| 4710. | QILDG |
| 4711. | ILDGI |
| 4712. | LDGIA |
| 4713. | DGIAD |
| 4714. | GIADT |
| 4715. | IADTI |
| 4716. | ADTIV |
| 4717. | DTIVD |
| 4718. | TIVDS |
| 4719. | IVDST |
| 4720. | VDSTV |
| 4721. | DSTVQ |
| 4722. | STVQD |
| 4723. | TVQDI |
| 4724. | VQDIL |
| 4725. | QDILD |
| 4726. | DILDK |
| 4727. | ILDKI |
| 4728. | LDKIT |
| 4729. | DKITT |
| 4730. | KITTD |
| 4731. | ITTDP |
| 4732. | TTDPS |
| 4733. | TDPSL |
| 4734. | DPSLG |
| 4735. | PSLGL |
| 4736. | SLGLL |
| 4737. | LGLLK |
| 4738. | GLLKA |
| 4739. | LLKAF |
| 4740. | LKAFN |
| 4741. | KAFNN |
| 4742. | AFNNF |
| 4743. | FNNFP |
| 4744. | NNFPI |
| 4745. | NFPIT |
| 4746. | FPITN |
| 4747. | PITNK |
| 4748. | ITNKI |
| 4749. | TNKIQ |
| 4750. | NKIQC |
| 4751. | KIQCN |
| 4752. | IQCNG |
| 4753. | QCNGL |
| 4754. | CNGLF |
| 4755. | NGLFT |
| 4756. | GLFTP |
| 4757. | LFTPS |
| 4758. | FTPSN |
| 4759. | TPSNI |
| 4760. | PSNIE |
| 4761. | SNIET |
| 4762. | NIETL |
| 4763. | IETLL |
| 4764. | ETLLG |
| 4765. | TLLGG |
| 4766. | LLGGT |
| 4767. | LGGTE |
| 4768. | GGTEI |
| 4769. | GTEIG |
| 4770. | TEIGK |
| 4771. | EIGKF |
| 4772. | IGKFT |
| 4773. | GKFTV |
| 4774. | KFTVT |
| 4775. | FTVTP |
| 4776. | TVTPK |
| 4777. | VTPKS |
| 4778. | TPKSS |
| 4779. | PKSSG |
| 4780. | KSSGS |
| 4781. | SSGSM |
| 4782. | SGSMF |
| 4783. | GSMFL |
| 4784. | SMFLV |
| 4785. | MFLVS |
| 4786. | FLVSA |
| 4787. | LVSAD |
| 4788. | VSADI |

TABLE 6-continued

| | |
|---|---|
| 4789. | SADII |
| 4790. | ADIIA |
| 4791. | DIIAS |
| 4792. | IIASR |
| 4793. | IASRM |
| 4794. | ASRME |
| 4795. | SRMEG |
| 4796. | RMEGG |
| 4797. | MEGGV |
| 4798. | EGGVV |
| 4799. | GGVVL |
| 4800. | GVVLA |
| 4801. | VVLAL |
| 4802. | VLALV |
| 4803. | LALVR |
| 4804. | ALVRE |
| 4805. | LVREG |
| 4806. | VREGD |
| 4807. | REGDS |
| 4808. | EGDSK |
| 4809. | GDSKP |
| 4810. | DSKPC |
| 4811. | SKPCA |
| 4812. | KPCAI |
| 4813. | PCAIS |
| 4814. | CAISY |
| 4815. | AISYG |
| 4816. | ISYGY |
| 4817. | SYGYS |
| 4818. | YGYSS |
| 4819. | GYSSG |
| 4820. | YSSGV |
| 4821. | SSGVP |
| 4822. | SGVPN |
| 4823. | GVPNL |
| 4824. | VPNLC |
| 4825. | PNLCS |
| 4826. | NLCSL |
| 4827. | LCSLR |
| 4828. | CSLRT |
| 4829. | SLRTS |
| 4830. | LRTSI |
| 4831. | RTSIT |
| 4832. | TSITN |
| 4833. | SITNT |
| 4834. | ITNTG |
| 4835. | TNTGL |
| 4836. | NTGLT |
| 4837. | TGLTP |
| 4838. | GLTPT |
| 4839. | LTPTT |
| 4840. | TPTTY |
| 4841. | PTTYS |
| 4842. | TTYSL |
| 4843. | TYSLR |
| 4844. | YSLRV |
| 4845. | SLRVG |
| 4846. | LRVGG |
| 4847. | RVGGL |
| 4848. | VGGLE |
| 4849. | GGLES |
| 4850. | GLESG |
| 4851. | LESGV |
| 4852. | ESGVV |
| 4853. | SGVVW |
| 4854. | GVVWV |
| 4855. | VVWVN |
| 4856. | VWVNA |
| 4857. | WVNAL |
| 4858. | VNALS |
| 4859. | NALSN |
| 4860. | ALSNG |
| 4861. | LSNGN |
| 4862. | SNGND |
| 4863. | NGNDI |
| 4864. | GNDIL |
| 4865. | NDILG |
| 4866. | DILGI |
| 4867. | ILGIT |
| 4868. | LGITN |

TABLE 6-continued

| | |
|---|---|
| 4869. | GITNT |
| 4870. | ITNTS |
| 4871. | TNTSN |
| 4872. | NTSNV |
| 4873. | TSNVS |
| 4874. | SNVSF |
| 4875. | NVSFL |
| 4876. | VSFLE |
| 4877. | SFLEV |
| 4878. | FLEVI |
| 4879. | LEVIP |
| 4880. | EVIPQ |
| 4881. | VIPQT |
| 4882. | IPQTN |
| 4883. | PQTNA |

5-mer peptides of CT823 (cHtrA, 497 amino acids), ACCESSION# NP 220344.1, GI: 15605558 (SEQ ID NOS: 4884-5376)

| | |
|---|---|
| 4884. | MMKRL |
| 4885. | MKRLL |
| 4886. | KRLLC |
| 4887. | RLLCV |
| 4888. | LLCVL |
| 4889. | LCVLL |
| 4890. | CVLLS |
| 4891. | VLLST |
| 4892. | LLSTS |
| 4893. | LSTSV |
| 4894. | STSVF |
| 4895. | TSVFS |
| 4896. | SVFSS |
| 4897. | VFSSP |
| 4898. | FSSPM |
| 4899. | SSPML |
| 4900. | SPMLG |
| 4901. | PMLGY |
| 4902. | MLGYS |
| 4903. | LGYSA |
| 4904. | GYSAS |
| 4905. | YSASK |
| 4906. | SASKK |
| 4907. | ASKKD |
| 4908. | SKKDS |
| 4909. | KKDSK |
| 4910. | KDSKA |
| 4911. | DSKAD |
| 4912. | SKADI |
| 4913. | KADIC |
| 4914. | ADICL |
| 4915. | DICLA |
| 4916. | ICLAV |
| 4917. | CLAVS |
| 4918. | LAVSS |
| 4919. | AVSSG |
| 4920. | VSSGD |
| 4921. | SSGDQ |
| 4922. | SGDQE |
| 4923. | GDQEV |
| 4924. | DQEVS |
| 4925. | QEVSQ |
| 4926. | EVSQE |
| 4927. | VSQED |
| 4928. | SQEDL |
| 4929. | QEDLL |
| 4930. | EDLLK |
| 4931. | DLLKE |
| 4932. | LLKEV |
| 4933. | LKEVS |
| 4934. | KEVSR |
| 4935. | EVSRG |
| 4936. | VSRGF |
| 4937. | SRGFS |
| 4938. | RGFSR |
| 4939. | GFSRV |
| 4940. | FSRVA |
| 4941. | SRVAA |
| 4942. | RVAAK |
| 4943. | VAAKA |

TABLE 6-continued

| | |
|---|---|
| 4944. | AAKAT |
| 4945. | AKATP |
| 4946. | KATPG |
| 4947. | ATPGV |
| 4948. | TPGVV |
| 4949. | PGVVY |
| 4950. | GVVYI |
| 4951. | VVYIE |
| 4952. | VYIEN |
| 4953. | YIENF |
| 4954. | IENFP |
| 4955. | ENFPK |
| 4956. | NFPKT |
| 4957. | FPKTG |
| 4958. | PKTGN |
| 4959. | KTGNQ |
| 4960. | TGNQA |
| 4961. | GNQAI |
| 4962. | NQAIA |
| 4963. | QAIAS |
| 4964. | AIASP |
| 4965. | IASPG |
| 4966. | ASPGN |
| 4967. | SPGNK |
| 4968. | PGNKR |
| 4969. | GNKRG |
| 4970. | NKRGF |
| 4971. | KRGFQ |
| 4972. | RGFQE |
| 4973. | GFQEN |
| 4974. | FQENP |
| 4975. | QENPF |
| 4976. | ENPFD |
| 4977. | NPFDY |
| 4978. | PFDYF |
| 4979. | FDYFN |
| 4980. | DYFND |
| 4981. | YFNDE |
| 4982. | FNDEF |
| 4983. | NDEFF |
| 4984. | DEFFN |
| 4985. | EFFNR |
| 4986. | FFNRF |
| 4987. | FNRFF |
| 4988. | NRFFG |
| 4989. | RFFGL |
| 4990. | FFGLP |
| 4991. | FGLPS |
| 4992. | GLPSH |
| 4993. | LPSHR |
| 4994. | PSHRE |
| 4995. | SHREQ |
| 4996. | HREQQ |
| 4997. | REQQR |
| 4998. | EQQRP |
| 4999. | QQRPQ |
| 5000. | QRPQQ |
| 5001. | RPQQR |
| 5002. | PQQRD |
| 5003. | QQRDA |
| 5004. | QRDAV |
| 5005. | RDAVR |
| 5006. | DAVRG |
| 5007. | AVRGT |
| 5008. | VRGTG |
| 5009. | RGTGF |
| 5010. | GTGFI |
| 5011. | TGFIV |
| 5012. | GFIVS |
| 5013. | FIVSE |
| 5014. | IVSED |
| 5015. | VSEDG |
| 5016. | SEDGY |
| 5017. | EDGYV |
| 5018. | DGYVV |
| 5019. | GYVVT |
| 5020. | YVVTN |
| 5021. | VVTNH |
| 5022. | VTNHH |
| 5023. | TNHHV |

TABLE 6-continued

| | | |
|---|---|---|
| 5024. | NHHVV | |
| 5025. | HHVVE | |
| 5026. | HVVED | |
| 5027. | VVEDA | |
| 5028. | VEDAG | |
| 5029. | EDAGK | |
| 5030. | DAGKI | |
| 5031. | AGKIH | |
| 5032. | GKIHV | |
| 5033. | KIHVT | |
| 5034. | IHVTL | |
| 5035. | HVTLH | |
| 5036. | VTLHD | |
| 5037. | TLHDG | |
| 5038. | LHDGQ | |
| 5039. | HDGQK | |
| 5040. | DGQKY | |
| 5041. | GQKYT | |
| 5042. | QKYTA | |
| 5043. | KYTAK | |
| 5044. | YTAKI | |
| 5045. | TAKIV | |
| 5046. | AKIVG | |
| 5047. | KIVGL | |
| 5048. | IVGLD | |
| 5049. | VGLDP | |
| 5050. | GLDPK | |
| 5051. | LDPKT | |
| 5052. | DPKTD | |
| 5053. | PKTDL | |
| 5054. | KTDLA | |
| 5055. | TDLAV | |
| 5056. | DLAVI | |
| 5057. | LAVIK | |
| 5058. | AVIKI | |
| 5059. | VIKIQ | |
| 5060. | IKIQA | |
| 5061. | KIQAE | |
| 5062. | IQAEK | |
| 5063. | QAEKL | |
| 5064. | AEKLP | |
| 5065. | EKLPF | |
| 5066. | KLPFL | |
| 5067. | LPFLT | |
| 5068. | PFLTF | |
| 5069. | FLTFG | |
| 5070. | LTFGN | |
| 5071. | TFGNS | |
| 5072. | FGNSD | |
| 5073. | GNSDQ | |
| 5074. | NSDQL | |
| 5075. | SDQLQ | |
| 5076. | DQLQI | |
| 5077. | QLQIG | |
| 5078. | LQIGD | |
| 5079. | QIGDW | |
| 5080. | IGDWA | |
| 5081. | GDWAI | |
| 5082. | DWAIA | |
| 5083. | WAIAI | |
| 5084. | AIAIG | |
| 5085. | IAIGN | |
| 5086. | AIGNP | |
| 5087. | IGNPF | |
| 5088. | GNPFG | |
| 5089. | NPFGL | |
| 5090. | PFGLQ | |
| 5091. | FGLQA | |
| 5092. | GLQAT | |
| 5093. | LQATV | |
| 5094. | QATVT | |
| 5095. | ATVTV | |
| 5096. | TVTVG | |
| 5097. | VTVGV | |
| 5098. | TVGVI | |
| 5099. | VGVIS | |
| 5100. | GVISA | |
| 5101. | VISAK | |
| 5102. | ISAKG | |
| 5103. | SAKGR | |
| 5104. | AKGRN | |
| 5105. | KGRNQ | |
| 5106. | GRNQL | |
| 5107. | RNQLH | |
| 5108. | NQLHI | |
| 5109. | QLHIV | |
| 5110. | LHIVD | |
| 5111. | HIVDF | |
| 5112. | IVDFE | |
| 5113. | VDFED | |
| 5114. | DFEDF | |
| 5115. | FEDFI | |
| 5116. | EDFIQ | |
| 5117. | DFIQT | |
| 5118. | FIQTD | |
| 5119. | IQTDA | |
| 5120. | QTDAA | |
| 5121. | TDAAI | |
| 5122. | DAAIN | |
| 5123. | AAINP | |
| 5124. | AINPG | |
| 5125. | INPGN | |
| 5126. | NPGNS | |
| 5127. | PGNSG | |
| 5128. | GNSGG | |
| 5129. | NSGGP | |
| 5130. | SGGPL | |
| 5131. | GGPLL | |
| 5132. | GPLLN | |
| 5133. | PLLNI | |
| 5134. | LLNIN | |
| 5135. | LNING | |
| 5136. | NINGQ | |
| 5137. | INGQV | |
| 5138. | NGQVI | |
| 5139. | GQVIG | |
| 5140. | QVIGV | |
| 5141. | VIGVN | |
| 5142. | IGVNT | |
| 5143. | GVNTA | |
| 5144. | VNTAI | |
| 5145. | NTAIV | |
| 5146. | TAIVS | |
| 5147. | AIVSG | |
| 5148. | IVSGS | |
| 5149. | VSGSG | |
| 5150. | SGSGG | |
| 5151. | GSGGY | |
| 5152. | SGGYI | |
| 5153. | GGYIG | |
| 5154. | GYIGI | |
| 5155. | YIGIG | |
| 5156. | IGIGF | |
| 5157. | GIGFA | |
| 5158. | IGFAI | |
| 5159. | GFAIP | |
| 5160. | FAIPS | |
| 5161. | AIPSL | |
| 5162. | IPSLM | |
| 5163. | PSLMA | |
| 5164. | SLMAK | |
| 5165. | LMAKR | |
| 5166. | MAKRV | |
| 5167. | AKRVI | |
| 5168. | KRVID | |
| 5169. | RVIDQ | |
| 5170. | VIDQL | |
| 5171. | IDQLI | |
| 5172. | DQLIS | |
| 5173. | QLISD | |
| 5174. | LISDG | |
| 5175. |ISDGQ | |
| 5176. | SDGQV | |
| 5177. | DGQVT | |
| 5178. | GQVTR | |
| 5179. | QVTRG | |
| 5180. | VTRGF | |
| 5181. | TRGFL | |
| 5182. | RGFLG | |
| 5183. | GFLGV | |

TABLE 6-continued

| | |
|---|---|
| 5184. | FLGVT |
| 5185. | LGVTL |
| 5186. | GVTLQ |
| 5187. | VTLQP |
| 5188. | TLQPI |
| 5189. | LQPID |
| 5190. | QPIDS |
| 5191. | PIDSE |
| 5192. | IDSEL |
| 5193. | DSELA |
| 5194. | SELAT |
| 5195. | ELATC |
| 5196. | LATCY |
| 5197. | ATCYK |
| 5198. | TCYKL |
| 5199. | CYKLE |
| 5200. | YKLEK |
| 5201. | KLEKV |
| 5202. | LEKVY |
| 5203. | EKVYG |
| 5204. | KVYGA |
| 5205. | VYGAL |
| 5206. | YGALV |
| 5207. | GALVT |
| 5208. | ALVTD |
| 5209. | LVTDV |
| 5210. | VTDVV |
| 5211. | TDVVK |
| 5212. | DVVKG |
| 5213. | VVKGS |
| 5214. | VKGSP |
| 5215. | KGSPA |
| 5216. | GSPAE |
| 5217. | SPAEK |
| 5218. | PAEKA |
| 5219. | AEKAG |
| 5220. | EKAGL |
| 5221. | KAGLR |
| 5222. | AGLRQ |
| 5223. | GLRQE |
| 5224. | LRQED |
| 5225. | RQEDV |
| 5226. | QEDVI |
| 5227. | EDVIV |
| 5228. | DVIVA |
| 5229. | VIVAY |
| 5230. | IVAYN |
| 5231. | VAYNG |
| 5232. | AYNGK |
| 5233. | YNGKE |
| 5234. | NGKEV |
| 5235. | GKEVE |
| 5236. | KEVES |
| 5237. | EVESL |
| 5238. | VESLS |
| 5239. | ESLSA |
| 5240. | SLSAL |
| 5241. | LSALR |
| 5242. | SALRN |
| 5243. | ALRNA |
| 5244. | LRNAI |
| 5245. | RNAIS |
| 5246. | NAISL |
| 5247. | AISLM |
| 5248. | ISLMM |
| 5249. | SLMMP |
| 5250. | LMMPG |
| 5251. | MMPGT |
| 5252. | MPGTR |
| 5253. | PGTRV |
| 5254. | GTRVV |
| 5255. | TRVVL |
| 5256. | RVVLK |
| 5257. | VVLKI |
| 5258. | VLKIV |
| 5259. | LKIVR |
| 5260. | KIVRE |
| 5261. | IVREG |
| 5262. | VREGK |
| 5263. | REGKT |
| 5264. | EGKTI |
| 5265. | GKTIE |
| 5266. | KTIEI |
| 5267. | TIEIP |
| 5268. | IEIPV |
| 5269. | EIPVT |
| 5270. | IPVTV |
| 5271. | PVTVT |
| 5272. | VTVTQ |
| 5273. | TVTQI |
| 5274. | VTQIP |
| 5275. | TQIPT |
| 5276. | QIPTE |
| 5277. | IPTED |
| 5278. | PTEDG |
| 5279. | TEDGV |
| 5280. | EDGVS |
| 5281. | DGVSA |
| 5282. | GVSAL |
| 5283. | VSALQ |
| 5284. | SALQK |
| 5285. | ALQKM |
| 5286. | LQKMG |
| 5287. | QKMGV |
| 5288. | KMGVR |
| 5289. | MGVRV |
| 5290. | GVRVQ |
| 5291. | VRVQN |
| 5292. | RVQNI |
| 5293. | VQNIT |
| 5294. | QNITP |
| 5295. | NITPE |
| 5296. | ITPEI |
| 5297. | TPEIC |
| 5298. | PEICK |
| 5299. | EICKK |
| 5300. | ICKKL |
| 5301. | CKKLG |
| 5302. | KKLGL |
| 5303. | KLGLA |
| 5304. | LGLAA |
| 5305. | GLAAD |
| 5306. | LAADT |
| 5307. | AADTR |
| 5308. | ADTRG |
| 5309. | DTRGI |
| 5310. | TRGIL |
| 5311. | RGILV |
| 5312. | GILVV |
| 5313. | ILVVA |
| 5314. | LVVAV |
| 5315. | VVAVE |
| 5316. | VAVEA |
| 5317. | AVEAG |
| 5318. | VEAGS |
| 5319. | EAGSP |
| 5320. | AGSPA |
| 5321. | GSPAA |
| 5322. | SPAAS |
| 5323. | PAASA |
| 5324. | AASAG |
| 5325. | ASAGV |
| 5326. | SAGVA |
| 5327. | AGVAP |
| 5328. | GVAPG |
| 5329. | VAPGQ |
| 5330. | APGQL |
| 5331. | PGQLI |
| 5332. | GQLIL |
| 5333. | QLILA |
| 5334. | LILAV |
| 5335. | ILAVN |
| 5336. | LAVNR |
| 5337. | AVNRQ |
| 5338. | VNRQR |
| 5339. | NRQRV |
| 5340. | RQRVA |
| 5341. | QRVAS |
| 5342. | RVASV |
| 5343. | VASVE |

TABLE 6-continued

| | |
|---|---|
| 5344. | ASVEE |
| 5345. | SVEEL |
| 5346. | VEELN |
| 5347. | EELNQ |
| 5348. | ELNQV |
| 5349. | LNQVL |
| 5350. | NQVLK |
| 5351. | QVLKN |
| 5352. | VLKNS |
| 5353. | LKNSK |
| 5354. | KNSKG |
| 5355. | NSKGE |
| 5356. | SKGEN |
| 5357. | KGENV |
| 5358. | GENVL |
| 5359. | ENVLL |
| 5360. | NVLLM |
| 5361. | VLLMV |
| 5362. | LLMVS |
| 5363. | LMVSQ |
| 5364. | MVSQG |
| 5365. | VSQGD |
| 5366. | SQGDV |
| 5367. | QGDVV |
| 5368. | GDVVR |
| 5369. | DVVRF |
| 5370. | VVRFI |
| 5371. | VRFIV |
| 5372. | RFIVL |
| 5373. | FIVLK |
| 5374. | IVLKS |
| 5375. | VLKSD |
| 5376. | LKSDE |

5-mer peptides of CT681 (MOMP, 393 amino acids), ACCESSION# NP 220200.1, GI: 15605414 (SEQ ID NOS: 5377-5765)

| | |
|---|---|
| 5377. | MKKLL |
| 5378. | KKLLK |
| 5379. | KLLKS |
| 5380. | LLKSV |
| 5381. | LKSVL |
| 5382. | KSVLV |
| 5383. | SVLVF |
| 5384. | VLVFA |
| 5385. | LVFAA |
| 5386. | VFAAL |
| 5387. | FAALS |
| 5388. | AALSS |
| 5389. | ALSSA |
| 5390. | LSSAS |
| 5391. | SSASS |
| 5392. | SASSL |
| 5393. | ASSLQ |
| 5394. | SSLQA |
| 5395. | SLQAL |
| 5396. | LQALP |
| 5397. | QALPV |
| 5398. | ALPVG |
| 5399. | LPVGN |
| 5400. | PVGNP |
| 5401. | VGNPA |
| 5402. | GNPAE |
| 5403. | NPAEP |
| 5404. | PAEPS |
| 5405. | AEPSL |
| 5406. | EPSLM |
| 5407. | PSLMI |
| 5408. | SLMID |
| 5409. | LMIDG |
| 5410. | MIDGI |
| 5411. | IDGIL |
| 5412. | DGILW |
| 5413. | GILWE |
| 5414. | ILWEG |
| 5415. | LWEGF |
| 5416. | WEGFG |
| 5417. | EGFGG |
| 5418. | GFGGD |

TABLE 6-continued

| | |
|---|---|
| 5419. | FGGDP |
| 5420. | GGDPC |
| 5421. | GDPCD |
| 5422. | DPCDP |
| 5423. | PCDPC |
| 5424. | CDPCA |
| 5425. | DPCAT |
| 5426. | PCATW |
| 5427. | CATWC |
| 5428. | ATWCD |
| 5429. | TWCDA |
| 5430. | WCDAI |
| 5431. | CDAIS |
| 5432. | DAISM |
| 5433. | AISMR |
| 5434. | ISMRV |
| 5435. | SMRVG |
| 5436. | MRVGY |
| 5437. | RVGYY |
| 5438. | VGYYG |
| 5439. | GYYGD |
| 5440. | YYGDF |
| 5441. | YGDFV |
| 5442. | GDFVF |
| 5443. | DFVFD |
| 5444. | FVFDR |
| 5445. | VFDRV |
| 5446. | FDRVL |
| 5447. | DRVLK |
| 5448. | RVLKT |
| 5449. | VLKTD |
| 5450. | LKTDV |
| 5451. | KTDVN |
| 5452. | TDVNK |
| 5453. | DVNKE |
| 5454. | VNKEF |
| 5455. | NKEFQ |
| 5456. | KEFQM |
| 5457. | EFQMG |
| 5458. | FQMGA |
| 5459. | QMGAK |
| 5460. | MGAKP |
| 5461. | GAKPT |
| 5462. | AKPTT |
| 5463. | KPTTD |
| 5464. | PTTDT |
| 5465. | TTDTG |
| 5466. | TDTGN |
| 5467. | DTGNS |
| 5468. | TGNSA |
| 5469. | GNSAA |
| 5470. | NSAAP |
| 5471. | SAAPS |
| 5472. | AAPST |
| 5473. | APSTL |
| 5474. | PSTLT |
| 5475. | STLTA |
| 5476. | TLTAR |
| 5477. | LTARE |
| 5478. | TAREN |
| 5479. | ARENP |
| 5480. | RENPA |
| 5481. | ENPAY |
| 5482. | NPAYG |
| 5483. | PAYGR |
| 5484. | AYGRH |
| 5485. | YGRHM |
| 5486. | GRHMQ |
| 5487. | RHMQD |
| 5488. | HMQDA |
| 5489. | MQDAE |
| 5490. | QDAEM |
| 5491. | DAEMF |
| 5492. | AEMFT |
| 5493. | EMFTN |
| 5494. | MFTNA |
| 5495. | FTNAA |
| 5496. | TNAAC |
| 5497. | NAACM |
| 5498. | AACMA |

TABLE 6-continued

| | |
|---|---|
| 5499. | ACMAL |
| 5500. | CMALN |
| 5501. | MALNI |
| 5502. | ALNIW |
| 5503. | LNIWD |
| 5504. | NIWDR |
| 5505. | IWDRF |
| 5506. | WDRFD |
| 5507. | DRFDV |
| 5508. | RFDVF |
| 5509. | FDVFC |
| 5510. | DVFCT |
| 5511. | VFCTL |
| 5512. | FCTLG |
| 5513. | CTLGA |
| 5514. | TLGAT |
| 5515. | LGATS |
| 5516. | GATSG |
| 5517. | ATSGY |
| 5518. | TSGYL |
| 5519. | SGYLK |
| 5520. | GYLKG |
| 5521. | YLKGN |
| 5522. | LKGNS |
| 5523. | KGNSA |
| 5524. | GNSAS |
| 5525. | NSASF |
| 5526. | SASFN |
| 5527. | ASFNL |
| 5528. | SFNLV |
| 5529. | FNLVG |
| 5530. | NLVGL |
| 5531. | LVGLF |
| 5532. | VGLFG |
| 5533. | GLFGD |
| 5534. | LFGDN |
| 5535. | FGDNE |
| 5536. | GDNEN |
| 5537. | DNENQ |
| 5538. | NENQK |
| 5539. | ENQKT |
| 5540. | NQKTV |
| 5541. | QKTVK |
| 5542. | KTVKA |
| 5543. | TVKAE |
| 5544. | VKAES |
| 5545. | KAESV |
| 5546. | AESVP |
| 5547. | ESVPN |
| 5548. | SVPNM |
| 5549. | VPNMS |
| 5550. | PNMSF |
| 5551. | NMSFD |
| 5552. | MSFDQ |
| 5553. | SFDQS |
| 5554. | FDQSV |
| 5555. | DQSVV |
| 5556. | QSVVE |
| 5557. | SVVEL |
| 5558. | VVELY |
| 5559. | VELYT |
| 5560. | ELYTD |
| 5561. | LYTDT |
| 5562. | YTDTT |
| 5563. | TDTTF |
| 5564. | DTTFA |
| 5565. | TTFAW |
| 5566. | TFAWS |
| 5567. | FAWSV |
| 5568. | AWSVG |
| 5569. | WSVGA |
| 5570. | SVGAR |
| 5571. | VGARA |
| 5572. | GARAA |
| 5573. | ARAAL |
| 5574. | RAALW |
| 5575. | AALWE |
| 5576. | ALWEC |
| 5577. | LWECG |
| 5578. | WECGC |
| 5579. | ECGCA |
| 5580. | CGCAT |
| 5581. | GCATL |
| 5582. | CATLG |
| 5583. | ATLGA |
| 5584. | TLGAS |
| 5585. | LGASF |
| 5586. | GASFQ |
| 5587. | ASFQY |
| 5588. | SFQYA |
| 5589. | FQYAQ |
| 5590. | QYAQS |
| 5591. | YAQSK |
| 5592. | AQSKP |
| 5593. | QSKPK |
| 5594. | SKPKV |
| 5595. | KPKVE |
| 5596. | PKVEE |
| 5597. | KVEEL |
| 5598. | VEELN |
| 5599. | EELNV |
| 5600. | ELNVL |
| 5601. | LNVLC |
| 5602. | NVLCN |
| 5603. | VLCNA |
| 5604. | LCNAA |
| 5605. | CNAAE |
| 5606. | NAAEF |
| 5607. | AAEFT |
| 5608. | AEFTI |
| 5609. | EFTIN |
| 5610. | FTINK |
| 5611. | TINKP |
| 5612. | INKPK |
| 5613. | NKPKG |
| 5614. | KPKGY |
| 5615. | PKGYV |
| 5616. | KGYVG |
| 5617. | GYVGK |
| 5618. | YVGKE |
| 5619. | VGKEF |
| 5620. | GKEFP |
| 5621. | KEFPL |
| 5622. | EFPLD |
| 5623. | FPLDL |
| 5624. | PLDLT |
| 5625. | LDLTA |
| 5626. | DLTAG |
| 5627. | LTAGT |
| 5628. | TAGTD |
| 5629. | AGTDA |
| 5630. | GTDAA |
| 5631. | TDAAT |
| 5632. | DAATG |
| 5633. | AATGT |
| 5634. | ATGTK |
| 5635. | TGTKD |
| 5636. | GTKDA |
| 5637. | TKDAS |
| 5638. | KDASI |
| 5639. | DASID |
| 5640. | ASIDY |
| 5641. | SIDYH |
| 5642. | IDYHE |
| 5643. | DYHEW |
| 5644. | YHEWQ |
| 5645. | HEWQA |
| 5646. | EWQAS |
| 5647. | WQASL |
| 5648. | QASLA |
| 5649. | ASLAL |
| 5650. | SLALS |
| 5651. | LALSY |
| 5652. | ALSYR |
| 5653. | LSYRL |
| 5654. | SYRLN |
| 5655. | YRLNM |
| 5656. | RLNMF |
| 5657. | LNMFT |
| 5658. | NMFTP |

TABLE 6-continued

| | | |
|---|---|---|
| 5659. | MFTPY | |
| 5660. | FTPYI | |
| 5661. | TPYIG | |
| 5662. | PYIGV | |
| 5663. | YIGVK | |
| 5664. | IGVKW | |
| 5665. | GVKWS | |
| 5666. | VKWSR | |
| 5667. | KWSRA | |
| 5668. | WSRAS | |
| 5669. | SRASF | |
| 5670. | RASFD | |
| 5671. | ASFDA | |
| 5672. | SFDAD | |
| 5673. | FDADT | |
| 5674. | DADTI | |
| 5675. | ADTIR | |
| 5676. | DTIRI | |
| 5677. | TIRIA | |
| 5678. | IRIAQ | |
| 5679. | RIAQP | |
| 5680. | IAQPK | |
| 5681. | AQPKS | |
| 5682. | QPKSA | |
| 5683. | PKSAT | |
| 5684. | KSATA | |
| 5685. | SATAI | |
| 5686. | ATAIF | |
| 5687. | TAIFD | |
| 5688. | AIFDT | |
| 5689. | IFDTT | |
| 5690. | FDTTT | |
| 5691. | DTTTL | |
| 5692. | TTTLN | |
| 5693. | TTLNP | |
| 5694. | TLNPT | |
| 5695. | LNPTI | |
| 5696. | NPTIA | |
| 5697. | PTIAG | |
| 5698. | TIAGA | |
| 5699. | IAGAG | |
| 5700. | AGAGD | |
| 5701. | GAGDV | |
| 5702. | AGDVK | |
| 5703. | GDVKT | |
| 5704. | DVKTG | |
| 5705. | VKTGA | |
| 5706. | KTGAE | |
| 5707. | TGAEG | |
| 5708. | GAEGQ | |
| 5709. | AEGQL | |
| 5710. | EGQLG | |
| 5711. | GQLGD | |
| 5712. | QLGDT | |
| 5713. | LGDTM | |
| 5714. | GDTMQ | |
| 5715. | DTMQI | |
| 5716. | TMQIV | |
| 5717. | MQIVS | |
| 5718. | QIVSL | |
| 5719. | IVSLQ | |
| 5720. | VSLQL | |
| 5721. | SLQLN | |
| 5722. | LQLNK | |
| 5723. | QLNKM | |
| 5724. | LNKMK | |
| 5725. | NKMKS | |
| 5726. | KMKSR | |
| 5727. | MKSRK | |
| 5728. | KSRKS | |
| 5729. | SRKSC | |
| 5730. | RKSCG | |
| 5731. | KSCGI | |
| 5732. | SCGIA | |
| 5733. | CGIAV | |
| 5734. | GIAVG | |
| 5735. | IAVGT | |
| 5736. | AVGTT | |
| 5737. | VGTTI | |
| 5738. | GTTIV | |

TABLE 6-continued

| | | |
|---|---|---|
| 5739. | TTIVD | |
| 5740. | TIVDA | |
| 5741. | IVDAD | |
| 5742. | VDADK | |
| 5743. | DADKY | |
| 5744. | ADKYA | |
| 5745. | DKYAV | |
| 5746. | KYAVT | |
| 5747. | YAVTV | |
| 5748. | AVTVE | |
| 5749. | VTVET | |
| 5750. | TVETR | |
| 5751. | VETRL | |
| 5752. | ETRLI | |
| 5753. | TRLID | |
| 5754. | RLIDE | |
| 5755. | LIDER | |
| 5756. | IDERA | |
| 5757. | DERAA | |
| 5758. | ERAAH | |
| 5759. | RAAHV | |
| 5760. | AAHVN | |
| 5761. | AHVNA | |
| 5762. | HVNAQ | |
| 5763. | VNAQF | |
| 5764. | NAQFR | |
| 5765. | AQFRF | |

5-mer peptides of CT119 (IncA, 273 amino acids), ACCESSION# NP219622.1, GI: 15604838 (SEQ ID NOS: 5766-6034)

| | |
|---|---|
| 5766. | MTTPT |
| 5767. | TTPTL |
| 5768. | TPTLI |
| 5769. | PTLIV |
| 5770. | TLIVT |
| 5771. | LIVTP |
| 5772. | IVTPP |
| 5773. | VTPPS |
| 5774. | TPPSP |
| 5775. | PPSPP |
| 5776. | PSPPA |
| 5777. | SPPAP |
| 5778. | PPAPS |
| 5779. | PAPSY |
| 5780. | APSYS |
| 5781. | PSYSA |
| 5782. | SYSAN |
| 5783. | YSANR |
| 5784. | SANRV |
| 5785. | ANRVP |
| 5786. | NRVPQ |
| 5787. | RVPQP |
| 5788. | VPQPS |
| 5789. | PQPSL |
| 5790. | QPSLM |
| 5791. | PSLMD |
| 5792. | SLMDK |
| 5793. | LMDKI |
| 5794. | MDKIK |
| 5795. | DKIKK |
| 5796. | KIKKI |
| 5797. | IKKIA |
| 5798. | KKIAA |
| 5799. | KIAAI |
| 5800. | IAAIA |
| 5801. | AAIAS |
| 5802. | AIASL |
| 5803. | IASLI |
| 5804. | ASLIL |
| 5805. | SLILI |
| 5806. | LILIG |
| 5807. | ILIGT |
| 5808. | LIGTI |
| 5809. | IGTIG |
| 5810. | GTIGF |
| 5811. | TIGFL |
| 5812. | IGFLA |
| 5813. | GFLAL |

TABLE 6-continued

| | |
|---|---|
| 5814. | FLALL |
| 5815. | LALLG |
| 5816. | ALLGH |
| 5817. | LLGHL |
| 5818. | LGHLV |
| 5819. | GHLVG |
| 5820. | HLVGF |
| 5821. | LVGFL |
| 5822. | VGFLI |
| 5823. | GFLIA |
| 5824. | FLIAP |
| 5825. | LIAPQ |
| 5826. | IAPQI |
| 5827. | APQIT |
| 5828. | PQITI |
| 5829. | QITIV |
| 5830. | ITIVL |
| 5831. | TIVLL |
| 5832. | IVLLA |
| 5833. | VLLAL |
| 5834. | LLALF |
| 5835. | LALFI |
| 5836. | ALFII |
| 5837. | LFIIS |
| 5838. | FIISL |
| 5839. | IISLA |
| 5840. | ISLAG |
| 5841. | SLAGN |
| 5842. | LAGNA |
| 5843. | AGNAL |
| 5844. | GNALY |
| 5845. | NALYL |
| 5846. | ALYLQ |
| 5847. | LYLQK |
| 5848. | YLQKT |
| 5849. | LQKTA |
| 5850. | QKTAN |
| 5851. | KTANL |
| 5852. | TANLH |
| 5853. | ANLHL |
| 5854. | NLHLY |
| 5855. | LHLYQ |
| 5856. | HLYQD |
| 5857. | LYQDL |
| 5858. | YQDLQ |
| 5859. | QDLQR |
| 5860. | DLQRE |
| 5861. | LQREV |
| 5862. | QREVG |
| 5863. | REVGS |
| 5864. | EVGSL |
| 5865. | VGSLK |
| 5866. | GSLKE |
| 5867. | SLKEI |
| 5868. | LKEIN |
| 5869. | KEINF |
| 5870. | EINFM |
| 5871. | INFML |
| 5872. | NFMLS |
| 5873. | FMLSV |
| 5874. | MLSVL |
| 5875. | LSVLQ |
| 5876. | SVLQK |
| 5877. | VLQKE |
| 5878. | LQKEF |
| 5879. | QKEFL |
| 5880. | KEFLH |
| 5881. | EFLHL |
| 5882. | FLHLS |
| 5883. | LHLSK |
| 5884. | HLSKE |
| 5885. | LSKEF |
| 5886. | SKEFA |
| 5887. | KEFAT |
| 5888. | EFATT |
| 5889. | FATTS |
| 5890. | ATTSK |
| 5891. | TTSKD |
| 5892. | TSKDL |
| 5893. | SKDLS |
| 5894. | KDLSA |
| 5895. | DLSAV |
| 5896. | LSAVS |
| 5897. | SAVSQ |
| 5898. | AVSQD |
| 5899. | VSQDF |
| 5900. | SQDFY |
| 5901. | QDFYS |
| 5902. | DFYSC |
| 5903. | FYSCL |
| 5904. | YSCLQ |
| 5905. | SCLQG |
| 5906. | CLQGF |
| 5907. | LQGFR |
| 5908. | QGFRD |
| 5909. | GFRDN |
| 5910. | FRDNY |
| 5911. | RDNYK |
| 5912. | DNYKG |
| 5913. | NYKGF |
| 5914. | YKGFE |
| 5915. | KGFES |
| 5916. | GFESL |
| 5917. | FESLL |
| 5918. | ESLLD |
| 5919. | SLLDE |
| 5920. | LLDEY |
| 5921. | LDEYK |
| 5922. | DEYKN |
| 5923. | EYKNS |
| 5924. | YKNST |
| 5925. | KNSTE |
| 5926. | NSTEE |
| 5927. | STEEM |
| 5928. | TEEMR |
| 5929. | EEMRK |
| 5930. | EMRKL |
| 5931. | MRKLF |
| 5932. | RKLFS |
| 5933. | KLFSQ |
| 5934. | LFSQE |
| 5935. | FSQEI |
| 5936. | SQEII |
| 5937. | QEIIA |
| 5938. | EIIAD |
| 5939. | IIADL |
| 5940. | IADLK |
| 5941. | ADLKG |
| 5942. | DLKGS |
| 5943. | LKGSV |
| 5944. | KGSVA |
| 5945. | GSVAS |
| 5946. | SVASL |
| 5947. | VASLR |
| 5948. | ASLRE |
| 5949. | SLREE |
| 5950. | LREEI |
| 5951. | REEIR |
| 5952. | EEIRF |
| 5953. | EIRFL |
| 5954. | IRFLT |
| 5955. | RFLTP |
| 5956. | FLTPL |
| 5957. | LTPLA |
| 5958. | TPLAE |
| 5959. | PLAEE |
| 5960. | LAEEV |
| 5961. | AEEVR |
| 5962. | EEVRR |
| 5963. | EVRRL |
| 5964. | VRRLA |
| 5965. | RRLAH |
| 5966. | RLAHN |
| 5967. | LAHNQ |
| 5968. | AHNQQ |
| 5969. | HNQQS |
| 5970. | NQQSL |
| 5971. | QQSLT |
| 5972. | QSLTV |
| 5973. | SLTVV |

TABLE 6-continued

| | |
|---|---|
| 5974. | LTVVI |
| 5975. | TVVIE |
| 5976. | VVIEE |
| 5977. | VIEEL |
| 5978. | IEELK |
| 5979. | EELKT |
| 5980. | ELKTI |
| 5981. | LKTIR |
| 5982. | KTIRD |
| 5983. | TIRDS |
| 5984. | IRDSL |
| 5985. | RDSLR |
| 5986. | DSLRD |
| 5987. | SLRDE |
| 5988. | LRDEI |
| 5989. | RDEIG |
| 5990. | DEIGQ |
| 5991. | EIGQL |
| 5992. | IGQLS |
| 5993. | GQLSQ |
| 5994. | QLSQL |
| 5995. | LSQLS |
| 5996. | SQLSK |
| 5997. | QLSKT |
| 5998. | LSKTL |
| 5999. | SKTLT |
| 6000. | KTLTS |
| 6001. | TLTSQ |
| 6002. | LTSQI |
| 6003. | TSQIA |
| 6004. | SQIAL |
| 6005. | QIALQ |
| 6006. | IALQR |
| 6007. | ALQRK |
| 6008. | LQRKE |
| 6009. | QRKES |
| 6010. | RKESS |
| 6011. | KESSD |
| 6012. | ESSDL |
| 6013. | SSDLC |
| 6014. | SDLCS |
| 6015. | DLCSQ |
| 6016. | LCSQI |
| 6017. | CSQIR |
| 6018. | SQIRE |
| 6019. | QIRET |
| 6020. | IRETL |
| 6021. | RETLS |
| 6022. | ETLSS |
| 6023. | TLSSP |
| 6024. | LSSPR |
| 6025. | SSPRK |
| 6026. | SPRKS |
| 6027. | PRKSA |
| 6028. | RKSAS |
| 6029. | KSASP |
| 6030. | SASPS |
| 6031. | ASPST |
| 6032. | SPSTK |
| 6033. | PSTKS |
| 6034. | STKSS |

5-mer peptides of CT813 (inclusion membrane protein, 264 amino acids), ACCESSION# NP 220333.1, GI: 15605547 (SEQ ID NOS: 6035-6294)

| | |
|---|---|
| 6035. | MTTLP |
| 6036. | TTLPN |
| 6037. | TLPNN |
| 6038. | LPNNC |
| 6039. | PNNCT |
| 6040. | NNCTS |
| 6041. | NCTSN |
| 6042. | CTSNS |
| 6043. | TSNSN |
| 6044. | SNSNS |
| 6045. | NSNSI |
| 6046. | SNSIN |
| 6047. | NSINT |
| 6048. | SINTF |
| 6049. | INTFT |
| 6050. | NTFTK |
| 6051. | TFTKD |
| 6052. | FTKDI |
| 6053. | TKDIE |
| 6054. | KDIEM |
| 6055. | DIEMA |
| 6056. | IEMAK |
| 6057. | EMAKQ |
| 6058. | MAKQI |
| 6059. | AKQIQ |
| 6060. | KQIQG |
| 6061. | QIQGS |
| 6062. | IQGSR |
| 6063. | QGSRK |
| 6064. | GSRKD |
| 6065. | SRKDP |
| 6066. | RKDPL |
| 6067. | KDPLA |
| 6068. | DPLAK |
| 6069. | PLAKT |
| 6070. | LAKTS |
| 6071. | AKTSW |
| 6072. | KTSWI |
| 6073. | TSWIA |
| 6074. | SWIAG |
| 6075. | WIAGL |
| 6076. | IAGLI |
| 6077. | AGLIC |
| 6078. | GLICV |
| 6079. | LICVV |
| 6080. | ICVVA |
| 6081. | CVVAG |
| 6082. | VVAGV |
| 6083. | VAGVL |
| 6084. | AGVLG |
| 6085. | GVLGL |
| 6086. | VLGLL |
| 6087. | LGLLA |
| 6088. | GLLAI |
| 6089. | LLAIG |
| 6090. | LAIGI |
| 6091. | AIGIG |
| 6092. | IGIGG |
| 6093. | GIGGC |
| 6094. | IGGCS |
| 6095. | GGCSM |
| 6096. | GCSMA |
| 6097. | CSMAS |
| 6098. | SMASG |
| 6099. | MASGL |
| 6100. | ASGLG |
| 6101. | SGLGL |
| 6102. | GLGLI |
| 6103. | LGLIG |
| 6104. | GLIGA |
| 6105. | LIGAI |
| 6106. | IGAIV |
| 6107. | GAIVA |
| 6108. | AIVAA |
| 6109. | IVAAV |
| 6110. | VAAVI |
| 6111. | AAVIV |
| 6112. | AVIVA |
| 6113. | VIVAV |
| 6114. | IVAVG |
| 6115. | VAVGL |
| 6116. | AVGLC |
| 6117. | VGLCC |
| 6118. | GLCCL |
| 6119. | LCCLV |
| 6120. | CCLVS |
| 6121. | CLVSA |
| 6122. | LVSAL |
| 6123. | VSALC |
| 6124. | SALCL |
| 6125. | ALCLQ |
| 6126. | LCLQV |
| 6127. | CLQVE |
| 6128. | LQVEK |

TABLE 6-continued

| | |
|---|---|
| 6129. | QVEKS |
| 6130. | VEKSQ |
| 6131. | EKSQW |
| 6132. | KSQWW |
| 6133. | SQWWQ |
| 6134. | QWWQK |
| 6135. | WWQKE |
| 6136. | WQKEF |
| 6137. | QKEFE |
| 6138. | KEFES |
| 6139. | EFESW |
| 6140. | FESWI |
| 6141. | ESWIE |
| 6142. | SWIEQ |
| 6143. | WIEQK |
| 6144. | IEQKS |
| 6145. | EQKSQ |
| 6146. | QKSQF |
| 6147. | KSQFR |
| 6148. | SQFRI |
| 6149. | QFRIV |
| 6150. | FRIVM |
| 6151. | RIVMA |
| 6152. | IVMAD |
| 6153. | VMADM |
| 6154. | MADML |
| 6155. | ADMLK |
| 6156. | DMLKA |
| 6157. | MLKAN |
| 6158. | LKANR |
| 6159. | KANRK |
| 6160. | ANRKL |
| 6161. | NRKLQ |
| 6162. | RKLQS |
| 6163. | KLQSE |
| 6164. | LQSEV |
| 6165. | QSEVE |
| 6166. | SEVEF |
| 6167. | EVEFL |
| 6168. | VEFLS |
| 6169. | EFLSK |
| 6170. | FLSKG |
| 6171. | LSKGW |
| 6172. | SKGWS |
| 6173. | KGWSD |
| 6174. | GWSDD |
| 6175. | WSDDT |
| 6176. | SDDTA |
| 6177. | DDTAV |
| 6178. | DTAVH |
| 6179. | TAVHK |
| 6180. | AVHKE |
| 6181. | VHKED |
| 6182. | HKEDV |
| 6183. | KEDVT |
| 6184. | EDVTK |
| 6185. | DVTKY |
| 6186. | VTKYE |
| 6187. | TKYEQ |
| 6188. | KYEQV |
| 6189. | YEQVV |
| 6190. | EQVVE |
| 6191. | QVVEE |
| 6192. | VVEEY |
| 6193. | VEEYA |
| 6194. | EEYAE |
| 6195. | EYAEK |
| 6196. | YAEKI |
| 6197. | AEKIM |
| 6198. | EKIME |
| 6199. | KIMEL |
| 6200. | IMELY |
| 6201. | MELYE |
| 6202. | ELYEE |
| 6203. | LYEET |
| 6204. | YEETG |
| 6205. | EETGV |
| 6206. | ETGVL |
| 6207. | TGVLT |
| 6208. | GVLTI |

TABLE 6-continued

| | |
|---|---|
| 6209. | VLTIE |
| 6210. | LTIEK |
| 6211. | TIEKI |
| 6212. | IEKIN |
| 6213. | EKINL |
| 6214. | KINLQ |
| 6215. | INLQK |
| 6216. | NLQKE |
| 6217. | LQKEK |
| 6218. | QKEKK |
| 6219. | KEKKA |
| 6220. | EKKAW |
| 6221. | KKAWL |
| 6222. | KAWLE |
| 6223. | AWLEE |
| 6224. | WLEEK |
| 6225. | LEEKA |
| 6226. | EEKAE |
| 6227. | EKAEM |
| 6228. | KAEME |
| 6229. | AEMEQ |
| 6230. | EMEQK |
| 6231. | MEQKL |
| 6232. | EQKLT |
| 6233. | QKLTT |
| 6234. | KLTTV |
| 6235. | LTTVT |
| 6236. | TTVTD |
| 6237. | TVTDL |
| 6238. | VTDLE |
| 6239. | TDLEA |
| 6240. | DLEAA |
| 6241. | LEAAK |
| 6242. | EAAKQ |
| 6243. | AAKQQ |
| 6244. | AKQQL |
| 6245. | KQQLE |
| 6246. | QQLEE |
| 6247. | QLEEK |
| 6248. | LEEKV |
| 6249. | EEKVT |
| 6250. | EKVTD |
| 6251. | KVTDL |
| 6252. | VTDLE |
| 6253. | TDLES |
| 6254. | DLESE |
| 6255. | LESEK |
| 6256. | ESEKQ |
| 6257. | SEKQE |
| 6258. | EKQEL |
| 6259. | KQELR |
| 6260. | QELRE |
| 6261. | ELREE |
| 6262. | LREEL |
| 6263. | REELD |
| 6264. | EELDK |
| 6265. | ELDKA |
| 6266. | LDKAI |
| 6267. | DKAIE |
| 6268. | KAIEN |
| 6269. | AIENL |
| 6270. | IENLD |
| 6271. | ENLDE |
| 6272. | NLDEM |
| 6273. | LDEMA |
| 6274. | DEMAY |
| 6275. | EMAYE |
| 6276. | MAYEA |
| 6277. | AYEAM |
| 6278. | YEAME |
| 6279. | EAMEF |
| 6280. | AMEFE |
| 6281. | MEFEK |
| 6282. | EFEKE |
| 6283. | FEKEK |
| 6284. | EKEKH |
| 6285. | KEKHG |
| 6286. | EKHGI |
| 6287. | KHGIK |
| 6288. | HGIKP |

TABLE 6-continued

| | |
|---|---|
| 6289. | GIKPG |
| 6290. | IKPGR |
| 6291. | KPGRR |
| 6292. | PGRRG |
| 6293. | GRRGS |
| 6294. | RRGSI |

5-mer peptides of CT795 (hypothetical protein, 163 amino acids), ACCESSION# NP 220315.1, GI: 15605529 (SEQ ID NOS: 6295-6453)

| | |
|---|---|
| 6295. | MRFLL |
| 6296. | RFLLA |
| 6297. | FLLAL |
| 6298. | LLALF |
| 6299. | LALFS |
| 6300. | ALFSL |
| 6301. | LFSLI |
| 6302. | FSLIL |
| 6303. | SLILV |
| 6304. | LILVL |
| 6305. | ILVLP |
| 6306. | LVLPA |
| 6307. | VLPAT |
| 6308. | LPATE |
| 6309. | PATEA |
| 6310. | ATEAF |
| 6311. | TEAFS |
| 6312. | EAFST |
| 6313. | AFSTE |
| 6314. | FSTED |
| 6315. | STEDK |
| 6316. | TEDKQ |
| 6317. | EDKQC |
| 6318. | DKQCQ |
| 6319. | KQCQQ |
| 6320. | QCQQE |
| 6321. | CQQEA |
| 6322. | QQEAE |
| 6323. | QEAEE |
| 6324. | EAEED |
| 6325. | AEEDC |
| 6326. | EEDCS |
| 6327. | EDCSQ |
| 6328. | DCSQV |
| 6329. | CSQVA |
| 6330. | SQVAD |
| 6331. | QVADT |
| 6332. | VADTC |
| 6333. | ADTCV |
| 6334. | DTCVF |
| 6335. | TCVFY |
| 6336. | CVFYS |
| 6337. | VFYSY |
| 6338. | FYSYA |
| 6339. | YSYAE |
| 6340. | SYAEG |
| 6341. | YAEGL |
| 6342. | AEGLE |
| 6343. | EGLEH |
| 6344. | GLEHA |
| 6345. | LEHAR |
| 6346. | EHARD |
| 6347. | HARDE |
| 6348. | ARDEG |
| 6349. | RDEGK |
| 6350. | DEGKL |
| 6351. | EGKLT |
| 6352. | GKLTL |
| 6353. | KLTLV |
| 6354. | LTLVV |
| 6355. | TLVVL |
| 6356. | LVVLL |
| 6357. | VVLLD |
| 6358. | VLLDT |
| 6359. | LLDTS |
| 6360. | LDTSG |
| 6361. | DTSGY |
| 6362. | TSGYS |
| 6363. | SGYSF |
| 6364. | GYSFE |
| 6365. | YSFET |
| 6366. | SFETL |
| 6367. | FETLA |
| 6368. | ETLAD |
| 6369. | TLADA |
| 6370. | LADAA |
| 6371. | ADAAH |
| 6372. | DAAHA |
| 6373. | AAHAM |
| 6374. | AHAME |
| 6375. | HAMES |
| 6376. | AMESS |
| 6377. | MESSL |
| 6378. | ESSLL |
| 6379. | SSLLS |
| 6380. | SLLST |
| 6381. | LLSTF |
| 6382. | LSTFA |
| 6383. | STFAD |
| 6384. | TFADF |
| 6385. | FADFV |
| 6386. | ADFVV |
| 6387. | DFVVL |
| 6388. | FVVLS |
| 6389. | VVLSR |
| 6390. | VLSRR |
| 6391. | LSRRE |
| 6392. | SRREA |
| 6393. | RREAV |
| 6394. | REAVP |
| 6395. | EAVPL |
| 6396. | AVPLI |
| 6397. | VPLIY |
| 6398. | PLIYP |
| 6399. | LIYPP |
| 6400. | IYPPV |
| 6401. | YPPVP |
| 6402. | PPVPD |
| 6403. | PVPDP |
| 6404. | VPDPM |
| 6405. | PDPMV |
| 6406. | DPMVG |
| 6407. | PMVGE |
| 6408. | MVGEI |
| 6409. | VGEIA |
| 6410. | GEIAL |
| 6411. | EIALF |
| 6412. | IALFL |
| 6413. | ALFLE |
| 6414. | LFLEA |
| 6415. | FLEAF |
| 6416. | LEAFS |
| 6417. | EAFSD |
| 6418. | AFSDQ |
| 6419. | FSDQT |
| 6420. | SDQTF |
| 6421. | DQTFP |
| 6422. | QTFPS |
| 6423. | TFPSQ |
| 6424. | FPSQP |
| 6425. | PSQPV |
| 6426. | SQPVI |
| 6427. | QPVIV |
| 6428. | PVIVT |
| 6429. | VIVTL |
| 6430. | IVTLA |
| 6431. | VTLAI |
| 6432. | TLAIG |
| 6433. | LAIGA |
| 6434. | AIGAS |
| 6435. | IGASS |
| 6436. | GASSA |
| 6437. | ASSAE |
| 6438. | SSAEI |
| 6439. | SAEIM |
| 6440. | AEIMD |
| 6441. | EIMDI |
| 6442. | IMDIT |
| 6443. | MDITE |

TABLE 6-continued

| | |
|---|---|
| 6444. | DITEI |
| 6445. | ITEIP |
| 6446. | TEIPS |
| 6447. | EIPSI |
| 6448. | IPSIN |
| 6449. | PSINP |
| 6450. | SINPE |
| 6451. | INPEF |
| 6452. | NPEFV |
| 6453. | PEFVE |

5-mer peptides of CT621 (hypothetical protein, 832 amino acids), ACCESSION# NP 220138.1, GI: 15605352 (SEQ ID NOS: 6454-7281)

| | |
|---|---|
| 6454. | MNRIH |
| 6455. | NRIHR |
| 6456. | RIHRT |
| 6457. | IHRTQ |
| 6458. | HRTQG |
| 6459. | RTQGS |
| 6460. | TQGSL |
| 6461. | QGSLT |
| 6462. | GSLTD |
| 6463. | SLTDY |
| 6464. | LTDYN |
| 6465. | TDYNS |
| 6466. | DYNST |
| 6467. | YNSTL |
| 6468. | NSTLE |
| 6469. | STLEA |
| 6470. | TLEAI |
| 6471. | LEAIA |
| 6472. | EAIAK |
| 6473. | AIAKK |
| 6474. | IAKKI |
| 6475. | AKKIA |
| 6476. | KKIAK |
| 6477. | KIAKP |
| 6478. | IAKPD |
| 6479. | AKPDS |
| 6480. | KPDSA |
| 6481. | PDSAT |
| 6482. | DSATI |
| 6483. | SATIV |
| 6484. | ATIVS |
| 6485. | TIVSQ |
| 6486. | IVSQV |
| 6487. | VSQVA |
| 6488. | SQVAQ |
| 6489. | QVAQY |
| 6490. | VAQYE |
| 6491. | AQYEQ |
| 6492. | QYEQF |
| 6493. | YEQFK |
| 6494. | EQFKM |
| 6495. | QFKME |
| 6496. | FKMEQ |
| 6497. | KMEQE |
| 6498. | MEQEA |
| 6499. | EQEAL |
| 6500. | QEALK |
| 6501. | EALKA |
| 6502. | ALKAL |
| 6503. | LKALL |
| 6504. | KALLV |
| 6505. | ALLVS |
| 6506. | LLVSF |
| 6507. | LVSFD |
| 6508. | VSFDQ |
| 6509. | SFDQK |
| 6510. | FDQKA |
| 6511. | DQKAD |
| 6512. | QKADQ |
| 6513. | KADQR |
| 6514. | ADQRY |
| 6515. | DQRYR |
| 6516. | QRYRN |
| 6517. | RYRNL |
| 6518. | YRNLI |

TABLE 6-continued

| | |
|---|---|
| 6519. | RNLIQ |
| 6520. | NLIQR |
| 6521. | LIQRL |
| 6522. | IQRLE |
| 6523. | QRLEQ |
| 6524. | RLEQL |
| 6525. | LEQLD |
| 6526. | EQLDV |
| 6527. | QLDVD |
| 6528. | LDVDR |
| 6529. | DVDRQ |
| 6530. | VDRQT |
| 6531. | DRQTG |
| 6532. | RQTGR |
| 6533. | QTGRS |
| 6534. | TGRST |
| 6535. | GRSTE |
| 6536. | RSTES |
| 6537. | STESQ |
| 6538. | TESQH |
| 6539. | ESQHI |
| 6540. | SQHIQ |
| 6541. | QHIQE |
| 6542. | HIQEK |
| 6543. | IQEKP |
| 6544. | QEKPM |
| 6545. | EKPMA |
| 6546. | KPMAS |
| 6547. | PMASL |
| 6548. | MASLQ |
| 6549. | ASLQS |
| 6550. | SLQSE |
| 6551. | LQSEN |
| 6552. | QSENQ |
| 6553. | SENQV |
| 6554. | ENQVV |
| 6555. | NQVVA |
| 6556. | QVVAQ |
| 6557. | VVAQA |
| 6558. | VAQAV |
| 6559. | AQAVV |
| 6560. | QAVVQ |
| 6561. | AVVQS |
| 6562. | VVQSD |
| 6563. | VQSDS |
| 6564. | QSDSS |
| 6565. | SDSSM |
| 6566. | DSSMP |
| 6567. | SSMPI |
| 6568. | SMPIF |
| 6569. | MPIFT |
| 6570. | PIFTG |
| 6571. | IFTGI |
| 6572. | FTGIK |
| 6573. | TGIKQ |
| 6574. | GIKQS |
| 6575. | IKQSW |
| 6576. | KQSWA |
| 6577. | QSWAV |
| 6578. | SWAVR |
| 6579. | WAVRL |
| 6580. | AVRLV |
| 6581. | VRLVQ |
| 6582. | RLVQG |
| 6583. | LVQGI |
| 6584. | VQGIR |
| 6585. | QGIRE |
| 6586. | GIREI |
| 6587. | IREIL |
| 6588. | REILD |
| 6589. | EILDQ |
| 6590. | ILDQV |
| 6591. | LDQVL |
| 6592. | DQVLV |
| 6593. | QVLVD |
| 6594. | VLVDT |
| 6595. | LVDTS |
| 6596. | VDTSL |
| 6597. | DTSLF |
| 6598. | TSLFT |

TABLE 6-continued

| | |
|---|---|
| 6599. | SLFTE |
| 6600. | LFTEE |
| 6601. | FTEEE |
| 6602. | TEEER |
| 6603. | EEERG |
| 6604. | EERGD |
| 6605. | ERGDL |
| 6606. | RGDLL |
| 6607. | GDLLA |
| 6608. | DLLAI |
| 6609. | LLAIR |
| 6610. | LAIRM |
| 6611. | AIRMD |
| 6612. | IRMDA |
| 6613. | RMDAA |
| 6614. | MDAAS |
| 6615. | DAASL |
| 6616. | AASLQ |
| 6617. | ASLQD |
| 6618. | SLQDK |
| 6619. | LQDKQ |
| 6620. | QDKQE |
| 6621. | DKQER |
| 6622. | KQERL |
| 6623. | QERLS |
| 6624. | ERLST |
| 6625. | RLSTE |
| 6626. | LSTED |
| 6627. | STEDI |
| 6628. | TEDIR |
| 6629. | EDIRS |
| 6630. | DIRSL |
| 6631. | IRSLL |
| 6632. | RSLLS |
| 6633. | SLLSL |
| 6634. | LLSLS |
| 6635. | LSLSN |
| 6636. | SLSND |
| 6637. | LSNDV |
| 6638. | SNDVM |
| 6639. | NDVMR |
| 6640. | DVMRV |
| 6641. | VMRVL |
| 6642. | MRVLQ |
| 6643. | RVLQK |
| 6644. | VLQKA |
| 6645. | LQKAS |
| 6646. | QKASV |
| 6647. | KASVS |
| 6648. | ASVSS |
| 6649. | SVSST |
| 6650. | VSSTR |
| 6651. | SSTRQ |
| 6652. | STRQL |
| 6653. | TRQLE |
| 6654. | RQLEL |
| 6655. | QLELI |
| 6656. | LELIQ |
| 6657. | ELIQS |
| 6658. | LIQSL |
| 6659. | IQSLI |
| 6660. | QSLID |
| 6661. | SLIDI |
| 6662. | LIDIF |
| 6663. | IDIFG |
| 6664. | DIFGT |
| 6665. | IFGTE |
| 6666. | FGTEE |
| 6667. | GTEEN |
| 6668. | TEENL |
| 6669. | EENLE |
| 6670. | ENLEQ |
| 6671. | NLEQS |
| 6672. | LEQSF |
| 6673. | EQSFA |
| 6674. | QSFAQ |
| 6675. | SFAQV |
| 6676. | FAQVR |
| 6677. | AQVRL |
| 6678. | QVRLE |
| 6679. | VRLEN |
| 6680. | RLENF |
| 6681. | LENFQ |
| 6682. | ENFQA |
| 6683. | NFQAI |
| 6684. | FQAIL |
| 6685. | QAILS |
| 6686. | AILSV |
| 6687. | ILSVI |
| 6688. | LSVIK |
| 6689. | SVIKE |
| 6690. | VIKER |
| 6691. | IKERL |
| 6692. | KERLT |
| 6693. | ERLTE |
| 6694. | RLTEE |
| 6695. | LTEEE |
| 6696. | TEEEF |
| 6697. | EEEFR |
| 6698. | EEFRV |
| 6699. | EFRVF |
| 6700. | FRVFQ |
| 6701. | RVFQE |
| 6702. | VFQEV |
| 6703. | FQEVS |
| 6704. | QEVSE |
| 6705. | EVSEE |
| 6706. | VSEEI |
| 6707. | SEEIS |
| 6708. | EEISS |
| 6709. | EISSI |
| 6710. | ISSIQ |
| 6711. | SSIQR |
| 6712. | SIQRT |
| 6713. | IQRTS |
| 6714. | QRTSE |
| 6715. | RTSES |
| 6716. | TSESH |
| 6717. | SESHL |
| 6718. | ESHLS |
| 6719. | SHLSP |
| 6720. | HLSPE |
| 6721. | LSPEH |
| 6722. | SPEHI |
| 6723. | PEHIE |
| 6724. | EHIEA |
| 6725. | HIEAI |
| 6726. | IEAIA |
| 6727. | EAIAR |
| 6728. | AIARV |
| 6729. | IARVG |
| 6730. | ARVGG |
| 6731. | RVGGH |
| 6732. | VGGHL |
| 6733. | GGHLS |
| 6734. | GHLSA |
| 6735. | HLSAK |
| 6736. | LSAKI |
| 6737. | SAKIV |
| 6738. | AKIVE |
| 6739. | KIVES |
| 6740. | IVESE |
| 6741. | VESEL |
| 6742. | ESELK |
| 6743. | SELKA |
| 6744. | ELKAS |
| 6745. | LKASQ |
| 6746. | KASQK |
| 6747. | ASQKV |
| 6748. | SQKVD |
| 6749. | QKVDL |
| 6750. | KVDLC |
| 6751. | VDLCQ |
| 6752. | DLCQR |
| 6753. | LCQRI |
| 6754. | CQRIA |
| 6755. | QRIAA |
| 6756. | RIAAM |
| 6757. | IAAMY |
| 6758. | AAMYQ |

TABLE 6-continued

| | |
|---|---|
| 6759. | AMYQE |
| 6760. | MYQEQ |
| 6761. | YQEQV |
| 6762. | QEQVD |
| 6763. | EQVDA |
| 6764. | QVDAV |
| 6765. | VDAVQ |
| 6766. | DAVQA |
| 6767. | AVQAY |
| 6768. | VQAYH |
| 6769. | QAYHS |
| 6770. | AYHSL |
| 6771. | YHSLE |
| 6772. | HSLEQ |
| 6773. | SLEQD |
| 6774. | LEQDA |
| 6775. | EQDAL |
| 6776. | QDALF |
| 6777. | DALFV |
| 6778. | ALFVN |
| 6779. | LFVNS |
| 6780. | FVNSR |
| 6781. | VNSRQ |
| 6782. | NSRQH |
| 6783. | SRQHS |
| 6784. | RQHSH |
| 6785. | QHSHF |
| 6786. | HSHFV |
| 6787. | SHFVQ |
| 6788. | HFVQV |
| 6789. | FVQVI |
| 6790. | VQVIS |
| 6791. | QVISL |
| 6792. | VISLV |
| 6793. | ISLVS |
| 6794. | SLVSS |
| 6795. | LVSSL |
| 6796. | VSSLM |
| 6797. | SSLMH |
| 6798. | SLMHS |
| 6799. | LMHSL |
| 6800. | MHSLS |
| 6801. | HSLSP |
| 6802. | SLSPT |
| 6803. | LSPTS |
| 6804. | SPTSE |
| 6805. | PTSEE |
| 6806. | TSEEE |
| 6807. | SEEER |
| 6808. | EEERI |
| 6809. | EERIL |
| 6810. | ERILL |
| 6811. | RILLN |
| 6812. | ILLNP |
| 6813. | LLNPA |
| 6814. | LNPAM |
| 6815. | NPAMM |
| 6816. | PAMMV |
| 6817. | AMMVS |
| 6818. | MMVSV |
| 6819. | MVSVL |
| 6820. | VSVLP |
| 6821. | SVLPT |
| 6822. | VLPTV |
| 6823. | LPTVR |
| 6824. | PTVRA |
| 6825. | TVRAI |
| 6826. | VRAIG |
| 6827. | RAIGL |
| 6828. | AIGLR |
| 6829. | IGLRF |
| 6830. | GLRFD |
| 6831. | LRFDF |
| 6832. | RFDFL |
| 6833. | FDFLT |
| 6834. | DFLTA |
| 6835. | FLTAE |
| 6836. | LTAEQ |
| 6837. | TAEQQ |
| 6838. | AEQQQ |
| 6839. | EQQQM |
| 6840. | QQQMV |
| 6841. | QQMVN |
| 6842. | QMVNA |
| 6843. | MVNAA |
| 6844. | VNAAV |
| 6845. | NAAVS |
| 6846. | AAVSS |
| 6847. | AVSSL |
| 6848. | VSSLQ |
| 6849. | SSLQQ |
| 6850. | SLQQQ |
| 6851. | LQQQQ |
| 6852. | QQQQL |
| 6853. | QQQLD |
| 6854. | QQLDE |
| 6855. | QLDEF |
| 6856. | LDEFL |
| 6857. | DEFLG |
| 6858. | EFLGV |
| 6859. | FLGVL |
| 6860. | LGVLC |
| 6861. | GVLCA |
| 6862. | VLCAH |
| 6863. | LCAHL |
| 6864. | CAHLV |
| 6865. | AHLVV |
| 6866. | HLVVV |
| 6867. | LVVVN |
| 6868. | VVVNC |
| 6869. | VVNCQ |
| 6870. | VNCQN |
| 6871. | NCQNK |
| 6872. | CQNKE |
| 6873. | QNKET |
| 6874. | NKETG |
| 6875. | KETGL |
| 6876. | ETGLL |
| 6877. | TGLLE |
| 6878. | GLLEG |
| 6879. | LLEGL |
| 6880. | LEGLE |
| 6881. | EGLEE |
| 6882. | GLEES |
| 6883. | LEESF |
| 6884. | EESFS |
| 6885. | ESFSE |
| 6886. | SFSET |
| 6887. | FSETL |
| 6888. | SETLS |
| 6889. | ETLSG |
| 6890. | TLSGL |
| 6891. | LSGLS |
| 6892. | SGLSN |
| 6893. | GLSNN |
| 6894. | LSNNF |
| 6895. | SNNFV |
| 6896. | NNFVL |
| 6897. | NFVLT |
| 6898. | FVLTA |
| 6899. | VLTAK |
| 6900. | LTAKM |
| 6901. | TAKMQ |
| 6902. | AKMQD |
| 6903. | KMQDI |
| 6904. | MQDIL |
| 6905. | QDILQ |
| 6906. | DILQV |
| 6907. | ILQVC |
| 6908. | LQVCS |
| 6909. | QVCSL |
| 6910. | VCSLQ |
| 6911. | CSLQG |
| 6912. | SLQGF |
| 6913. | LQGFV |
| 6914. | QGFVT |
| 6915. | GFVTL |
| 6916. | FVTLA |
| 6917. | VTLAN |
| 6918. | TLANG |

TABLE 6-continued

| | |
|---|---|
| 6919. | LANGD |
| 6920. | ANGDR |
| 6921. | NGDRY |
| 6922. | GDRYE |
| 6923. | DRYEL |
| 6924. | RYELF |
| 6925. | YELFS |
| 6926. | ELFSY |
| 6927. | LFSYN |
| 6928. | FSYND |
| 6929. | SYNDS |
| 6930. | YNDSG |
| 6931. | NDSGE |
| 6932. | DSGEA |
| 6933. | SGEAV |
| 6934. | GEAVC |
| 6935. | EAVCD |
| 6936. | AVCDE |
| 6937. | VCDEI |
| 6938. | CDEIA |
| 6939. | DEIAL |
| 6940. | EIALG |
| 6941. | IALGD |
| 6942. | ALGDG |
| 6943. | LGDGF |
| 6944. | GDGFH |
| 6945. | DGFHK |
| 6946. | GFHKV |
| 6947. | FHKVL |
| 6948. | HKVLG |
| 6949. | KVLGT |
| 6950. | VLGTM |
| 6951. | LGTML |
| 6952. | GTMLA |
| 6953. | TMLAV |
| 6954. | MLAVA |
| 6955. | LAVAL |
| 6956. | AVALS |
| 6957. | VALSQ |
| 6958. | ALSQA |
| 6959. | LSQAE |
| 6960. | SQAEV |
| 6961. | QAEVF |
| 6962. | AEVFK |
| 6963. | EVFKQ |
| 6964. | VFKQE |
| 6965. | FKQEC |
| 6966. | KQECD |
| 6967. | QECDR |
| 6968. | ECDRF |
| 6969. | CDRFI |
| 6970. | DRFIL |
| 6971. | RFILQ |
| 6972. | FILQA |
| 6973. | ILQAD |
| 6974. | LQADS |
| 6975. | QADSE |
| 6976. | ADSEK |
| 6977. | DSEKN |
| 6978. | SEKNM |
| 6979. | EKNMI |
| 6980. | KNMIH |
| 6981. | NMIHK |
| 6982. | MIHKR |
| 6983. | IHKRM |
| 6984. | HKRMV |
| 6985. | KRMVQ |
| 6986. | RMVQG |
| 6987. | MVQGE |
| 6988. | VQGEQ |
| 6989. | QGEQK |
| 6990. | GEQKS |
| 6991. | EQKSL |
| 6992. | QKSLF |
| 6993. | KSLFL |
| 6994. | SLFLT |
| 6995. | LFLTK |
| 6996. | FLTKM |
| 6997. | LTKMQ |
| 6998. | TKMQT |
| 6999. | KMQTE |
| 7000. | MQTEL |
| 7001. | QTELN |
| 7002. | TELNA |
| 7003. | ELNAG |
| 7004. | LNAGK |
| 7005. | NAGKT |
| 7006. | AGKTI |
| 7007. | GKTIA |
| 7008. | KTIAQ |
| 7009. | TIAQT |
| 7010. | IAQTK |
| 7011. | AQTKE |
| 7012. | QTKEV |
| 7013. | TKEVE |
| 7014. | KEVEA |
| 7015. | EVEAS |
| 7016. | VEASP |
| 7017. | EASPL |
| 7018. | ASPLP |
| 7019. | SPLPS |
| 7020. | PLPSA |
| 7021. | LPSAV |
| 7022. | PSAVA |
| 7023. | SAVAS |
| 7024. | AVASV |
| 7025. | VASVL |
| 7026. | ASVLI |
| 7027. | SVLID |
| 7028. | VLIDH |
| 7029. | LIDHY |
| 7030. | IDHYM |
| 7031. | DHYMP |
| 7032. | HYMPK |
| 7033. | YMPKE |
| 7034. | MPKEV |
| 7035. | PKEVE |
| 7036. | KEVEF |
| 7037. | EVEFL |
| 7038. | VEFLE |
| 7039. | EFLEK |
| 7040. | FLEKI |
| 7041. | LEKIS |
| 7042. | EKISS |
| 7043. | KISSR |
| 7044. | ISSRL |
| 7045. | SSRLY |
| 7046. | SRLYY |
| 7047. | RLYYG |
| 7048. | LYYGN |
| 7049. | YYGNK |
| 7050. | YGNKG |
| 7051. | GNKGS |
| 7052. | NKGSD |
| 7053. | KGSDI |
| 7054. | GSDIG |
| 7055. | SDIGN |
| 7056. | DIGNT |
| 7057. | IGNTI |
| 7058. | GNTIL |
| 7059. | NTILD |
| 7060. | TILDA |
| 7061. | ILDAI |
| 7062. | LDAIS |
| 7063. | DAISL |
| 7064. | AISLY |
| 7065. | ISLYV |
| 7066. | SLYVN |
| 7067. | LYVNS |
| 7068. | YVNSA |
| 7069. | VNSAT |
| 7070. | NSATY |
| 7071. | SATYF |
| 7072. | ATYFG |
| 7073. | TYFGF |
| 7074. | YFGFA |
| 7075. | FGFAN |
| 7076. | GFANY |
| 7077. | FANYI |
| 7078. | ANYIG |

TABLE 6-continued

| | |
|---|---|
| 7079. | NYIGQ |
| 7080. | YIGQP |
| 7081. | IGQPP |
| 7082. | GQPPV |
| 7083. | QPPVV |
| 7084. | PPVVG |
| 7085. | PVVGK |
| 7086. | VVGKT |
| 7087. | VGKTR |
| 7088. | GKTRE |
| 7089. | KTREN |
| 7090. | TRENT |
| 7091. | RENIF |
| 7092. | ENIFA |
| 7093. | NIFAG |
| 7094. | IFAGS |
| 7095. | FAGSA |
| 7096. | AGSAD |
| 7097. | GSADN |
| 7098. | SADNA |
| 7099. | ADNAK |
| 7100. | DNAKA |
| 7101. | NAKAK |
| 7102. | AKAKL |
| 7103. | KAKLD |
| 7104. | AKLDE |
| 7105. | KLDEE |
| 7106. | LDEEK |
| 7107. | DEEKK |
| 7108. | EEKKQ |
| 7109. | EKKQV |
| 7110. | KKQVD |
| 7111. | KQVDV |
| 7112. | QVDVF |
| 7113. | VDVFL |
| 7114. | DVFLE |
| 7115. | VFLEI |
| 7116. | FLEIT |
| 7117. | LEITE |
| 7118. | EITEA |
| 7119. | ITEAA |
| 7120. | TEAAK |
| 7121. | EAAKT |
| 7122. | AAKTT |
| 7123. | AKTTV |
| 7124. | KTTVT |
| 7125. | TTVTN |
| 7126. | TVTNQ |
| 7127. | VTNQQ |
| 7128. | TNQQS |
| 7129. | NQQSA |
| 7130. | QQSAV |
| 7131. | QSAVT |
| 7132. | SAVTN |
| 7133. | AVTND |
| 7134. | VTNDD |
| 7135. | TNDDK |
| 7136. | NDDKL |
| 7137. | DDKLS |
| 7138. | DKLST |
| 7139. | KLSTE |
| 7140. | LSTEQ |
| 7141. | STEQK |
| 7142. | TEQKA |
| 7143. | EQKAK |
| 7144. | QKAKI |
| 7145. | KAKIK |
| 7146. | AKIKA |
| 7147. | KIKAE |
| 7148. | IKAEL |
| 7149. | KAELT |
| 7150. | AELTQ |
| 7151. | ELTQY |
| 7152. | LTQYT |
| 7153. | TQYTD |
| 7154. | QYTDM |
| 7155. | YTDML |
| 7156. | TDMLN |
| 7157. | DMLNA |
| 7158. | MLNAI |

TABLE 6-continued

| | |
|---|---|
| 7159. | LNAIS |
| 7160. | NAISN |
| 7161. | AISNS |
| 7162. | ISNSL |
| 7163. | SNSLT |
| 7164. | NSLTS |
| 7165. | SLTSL |
| 7166. | LTSLK |
| 7167. | TSLKT |
| 7168. | SLKTQ |
| 7169. | LKTQL |
| 7170. | KTQLA |
| 7171. | TQLAP |
| 7172. | QLAPL |
| 7173. | LAPLS |
| 7174. | APLSV |
| 7175. | PLSVS |
| 7176. | LSVST |
| 7177. | SVSTV |
| 7178. | VSTVE |
| 7179. | STVEG |
| 7180. | TVEGV |
| 7181. | VEGVD |
| 7182. | EGVDG |
| 7183. | GVDGV |
| 7184. | VDGVF |
| 7185. | DGVFE |
| 7186. | GVFEV |
| 7187. | VFEVK |
| 7188. | FEVKN |
| 7189. | EVKNG |
| 7190. | VKNGI |
| 7191. | KNGIP |
| 7192. | NGIPG |
| 7193. | GIPGE |
| 7194. | IPGEN |
| 7195. | PGENG |
| 7196. | GENGK |
| 7197. | ENGKN |
| 7198. | NGKNW |
| 7199. | GKNWR |
| 7200. | KNWRL |
| 7201. | NWRLV |
| 7202. | WRLVL |
| 7203. | RLVLQ |
| 7204. | LVLQT |
| 7205. | VLQTL |
| 7206. | LQTLE |
| 7207. | QTLED |
| 7208. | TLEDT |
| 7209. | LEDTV |
| 7210. | EDTVV |
| 7211. | DTVVS |
| 7212. | TVVSG |
| 7213. | VVSGE |
| 7214. | VSGEV |
| 7215. | SGEVG |
| 7216. | GEVGS |
| 7217. | EVGSP |
| 7218. | VGSPT |
| 7219. | GSPTN |
| 7220. | SPTNI |
| 7221. | PTNIG |
| 7222. | TNIGM |
| 7223. | NIGMF |
| 7224. | IGMFQ |
| 7225. | GMFQM |
| 7226. | MFQMQ |
| 7227. | FQMQA |
| 7228. | QMQAL |
| 7229. | MQALV |
| 7230. | QALVH |
| 7231. | ALVHL |
| 7232. | LVHLN |
| 7233. | VHLNQ |
| 7234. | HLNQQ |
| 7235. | LNQQA |
| 7236. | NQQAY |
| 7237. | QQAYA |
| 7238. | QAYAD |

TABLE 6-continued

| | |
|---|---|
| 7239. | AYADM |
| 7240. | YADMG |
| 7241. | ADMGQ |
| 7242. | DMGQN |
| 7243. | MGQNF |
| 7244. | GQNFQ |
| 7245. | QNFQL |
| 7246. | NFQLE |
| 7247. | FQLEL |
| 7248. | QLELQ |
| 7249. | LELQM |
| 7250. | ELQMH |
| 7251. | LQMHL |
| 7252. | QMHLT |
| 7253. | MHLTS |
| 7254. | HLTSM |
| 7255. | LTSMQ |
| 7256. | TSMQQ |
| 7257. | SMQQE |
| 7258. | MQQEW |
| 7259. | QQEWM |
| 7260. | QEWMV |
| 7261. | EWMVV |
| 7262. | WMVVA |
| 7263. | MVVAT |
| 7264. | VVATS |
| 7265. | VATSL |
| 7266. | ATSLQ |
| 7267. | TSLQL |
| 7268. | SLQLL |
| 7269. | LQLLN |
| 7270. | QLLNQ |
| 7271. | LLNQI |
| 7272. | LNQIY |
| 7273. | NQIYL |
| 7274. | QIYLG |
| 7275. | IYLGL |
| 7276. | YLGLA |
| 7277. | LGLAR |
| 7278. | GLARN |
| 7279. | LARNL |
| 7280. | ARNLL |
| 7281. | RNLLR |

5-mer peptides of CT622 (hypothetical protein, 647 amino acids), ACCESSION# NP 220139.1, GI: 15605353 (SEQ ID NOS: 7282-7924)

| | |
|---|---|
| 7282. | MESGP |
| 7283. | ESGPE |
| 7284. | SGPES |
| 7285. | GPESV |
| 7286. | PESVS |
| 7287. | ESVSS |
| 7288. | SVSSN |
| 7289. | VSSNQ |
| 7290. | SSNQS |
| 7291. | SNQSS |
| 7292. | NQSSM |
| 7293. | QSSMN |
| 7294. | SSMNP |
| 7295. | SMNPI |
| 7296. | MNPII |
| 7297. | NPIIN |
| 7298. | PIING |
| 7299. | IINGQ |
| 7300. | INGQI |
| 7301. | NGQIA |
| 7302. | GQIAS |
| 7303. | QIASN |
| 7304. | IASNS |
| 7305. | ASNSE |
| 7306. | SNSET |
| 7307. | NSETK |
| 7308. | SETKE |
| 7309. | ETKES |
| 7310. | TKEST |
| 7311. | KESTK |
| 7312. | ESTKE |
| 7313. | STKES |

TABLE 6-continued

| | |
|---|---|
| 7314. | TKESE |
| 7315. | KESEA |
| 7316. | ESEAS |
| 7317. | SEASP |
| 7318. | EASPS |
| 7319. | ASPSA |
| 7320. | SPSAS |
| 7321. | PSASS |
| 7322. | SASSS |
| 7323. | ASSSV |
| 7324. | SSSVS |
| 7325. | SSVSS |
| 7326. | SVSSW |
| 7327. | VSSWS |
| 7328. | SSWSF |
| 7329. | SWSFL |
| 7330. | WSFLS |
| 7331. | SFLSS |
| 7332. | FLSSA |
| 7333. | LSSAK |
| 7334. | SSAKH |
| 7335. | SAKHA |
| 7336. | AKHAL |
| 7337. | KHALI |
| 7338. | HALIS |
| 7339. | ALISL |
| 7340. | LISLR |
| 7341. | ISLRD |
| 7342. | SLRDA |
| 7343. | LRDAI |
| 7344. | RDAIL |
| 7345. | DAILN |
| 7346. | AILNK |
| 7347. | ILNKN |
| 7348. | LNKNS |
| 7349. | NKNSS |
| 7350. | KNSSP |
| 7351. | NSSPT |
| 7352. | SSPTD |
| 7353. | SPTDS |
| 7354. | PTDSL |
| 7355. | TDSLS |
| 7356. | DSLSQ |
| 7357. | SLSQL |
| 7358. | LSQLE |
| 7359. | SQLEA |
| 7360. | QLEAS |
| 7361. | LEAST |
| 7362. | EASTS |
| 7363. | ASTST |
| 7364. | STSTS |
| 7365. | TSTST |
| 7366. | STSTV |
| 7367. | TSTVT |
| 7368. | STVTR |
| 7369. | TVTRV |
| 7370. | VTRVA |
| 7371. | TRVAA |
| 7372. | RVAAR |
| 7373. | VAARD |
| 7374. | AARDY |
| 7375. | ARDYN |
| 7376. | RDYNE |
| 7377. | DYNEA |
| 7378. | YNEAK |
| 7379. | NEAKS |
| 7380. | EAKSN |
| 7381. | AKSNF |
| 7382. | KSNFD |
| 7383. | SNFDT |
| 7384. | NFDTA |
| 7385. | FDTAK |
| 7386. | DTAKS |
| 7387. | TAKSG |
| 7388. | AKSGL |
| 7389. | KSGLE |
| 7390. | SGLEN |
| 7391. | GLENA |
| 7392. | LENAT |
| 7393. | ENATT |

TABLE 6-continued

| | |
|---|---|
| 7394. | NATTL |
| 7395. | ATTLA |
| 7396. | TTLAE |
| 7397. | TLAEY |
| 7398. | LAEYE |
| 7399. | AEYET |
| 7400. | EYETK |
| 7401. | YETKM |
| 7402. | ETKMA |
| 7403. | TKMAD |
| 7404. | KMADL |
| 7405. | MADLM |
| 7406. | ADLMA |
| 7407. | DLMAA |
| 7408. | LMAAL |
| 7409. | MAALQ |
| 7410. | AALQD |
| 7411. | ALQDM |
| 7412. | LQDME |
| 7413. | QDMER |
| 7414. | DMERL |
| 7415. | MERLA |
| 7416. | ERLAK |
| 7417. | RLAKQ |
| 7418. | LAKQK |
| 7419. | AKQKA |
| 7420. | KQKAE |
| 7421. | QKAEV |
| 7422. | KAEVT |
| 7423. | AEVTR |
| 7424. | EVTRI |
| 7425. | VTRIK |
| 7426. | TRIKE |
| 7427. | RIKEA |
| 7428. | IKEAL |
| 7429. | KEALQ |
| 7430. | EALQE |
| 7431. | ALQEK |
| 7432. | LQEKQ |
| 7433. | QEKQE |
| 7434. | EKQEV |
| 7435. | KQEVI |
| 7436. | QEVID |
| 7437. | EVIDK |
| 7438. | VIDKL |
| 7439. | IDKLN |
| 7440. | DKLNQ |
| 7441. | KLNQL |
| 7442. | LNQLV |
| 7443. | NQLVK |
| 7444. | QLVKL |
| 7445. | LVKLE |
| 7446. | VKLEK |
| 7447. | KLEKQ |
| 7448. | LEKQN |
| 7449. | EKQNQ |
| 7450. | KQNQT |
| 7451. | QNQTL |
| 7452. | NQTLK |
| 7453. | QTLKE |
| 7454. | TLKET |
| 7455. | LKETL |
| 7456. | KETLT |
| 7457. | ETLTT |
| 7458. | TLTTT |
| 7459. | LTTTD |
| 7460. | TTTDS |
| 7461. | TTDSA |
| 7462. | TDSAD |
| 7463. | DSADQ |
| 7464. | SADQI |
| 7465. | ADQIP |
| 7466. | DQIPA |
| 7467. | QIPAI |
| 7468. | IPAIN |
| 7469. | PAINS |
| 7470. | AINSQ |
| 7471. | INSQL |
| 7472. | NSQLE |
| 7473. | SQLEI |
| 7474. | QLEIN |
| 7475. | LEINK |
| 7476. | EINKN |
| 7477. | INKNS |
| 7478. | NKNSA |
| 7479. | KNSAD |
| 7480. | NSADQ |
| 7481. | SADQI |
| 7482. | ADQII |
| 7483. | DQIIK |
| 7484. | QIIKD |
| 7485. | IIKDL |
| 7486. | IKDLE |
| 7487. | KDLEG |
| 7488. | DLEGQ |
| 7489. | LEGQN |
| 7490. | EGQNI |
| 7491. | GQNIS |
| 7492. | QNISY |
| 7493. | NISYE |
| 7494. | ISYEA |
| 7495. | SYEAV |
| 7496. | YEAVL |
| 7497. | EAVLT |
| 7498. | AVLTN |
| 7499. | VLTNA |
| 7500. | LTNAG |
| 7501. | TNAGE |
| 7502. | NAGEV |
| 7503. | AGEVI |
| 7504. | GEVIK |
| 7505. | EVIKA |
| 7506. | VIKAS |
| 7507. | IKASS |
| 7508. | KASSE |
| 7509. | ASSEA |
| 7510. | SSEAG |
| 7511. | SEAGI |
| 7512. | EAGIK |
| 7513. | AGIKL |
| 7514. | GIKLG |
| 7515. | IKLGQ |
| 7516. | KLGQA |
| 7517. | LGQAL |
| 7518. | GQALQ |
| 7519. | QALQS |
| 7520. | ALQSI |
| 7521. | LQSIV |
| 7522. | QSIVD |
| 7523. | SIVDA |
| 7524. | IVDAG |
| 7525. | VDAGD |
| 7526. | DAGDQ |
| 7527. | AGDQS |
| 7528. | GDQSQ |
| 7529. | DQSQA |
| 7530. | QSQAA |
| 7531. | SQAAV |
| 7532. | QAAVL |
| 7533. | AAVLQ |
| 7534. | AVLQA |
| 7535. | VLQAQ |
| 7536. | LQAQQ |
| 7537. | QAQQN |
| 7538. | AQQNN |
| 7539. | QQNNS |
| 7540. | QNNSP |
| 7541. | NNSPD |
| 7542. | NSPDN |
| 7543. | SPDNI |
| 7544. | PDNIA |
| 7545. | DNIAA |
| 7546. | NIAAT |
| 7547. | IAATK |
| 7548. | AATKK |
| 7549. | ATKKL |
| 7550. | TKKLI |
| 7551. | KKLID |
| 7552. | KLIDA |
| 7553. | LIDAA |

TABLE 6-continued

| | |
|---|---|
| 7554. | IDAAE |
| 7555. | DAAET |
| 7556. | AAETK |
| 7557. | AETKV |
| 7558. | ETKVN |
| 7559. | TKVNE |
| 7560. | KVNEL |
| 7561. | VNELK |
| 7562. | NELKQ |
| 7563. | ELKQE |
| 7564. | LKQEH |
| 7565. | KQEHT |
| 7566. | QEHTG |
| 7567. | EHTGL |
| 7568. | HTGLT |
| 7569. | TGLTD |
| 7570. | GLTDS |
| 7571. | LTDSP |
| 7572. | TDSPL |
| 7573. | DSPLV |
| 7574. | SPLVK |
| 7575. | PLVKK |
| 7576. | LVKKA |
| 7577. | VKKAE |
| 7578. | KKAEE |
| 7579. | KAEEQ |
| 7580. | AEEQI |
| 7581. | EEQIS |
| 7582. | EQISQ |
| 7583. | QISQA |
| 7584. | ISQAQ |
| 7585. | SQAQK |
| 7586. | QAQKD |
| 7587. | AQKDI |
| 7588. | QKDIQ |
| 7589. | KDIQE |
| 7590. | DIQEI |
| 7591. | IQEIK |
| 7592. | QEIKP |
| 7593. | EIKPS |
| 7594. | IKPSG |
| 7595. | KPSGS |
| 7596. | PSGSD |
| 7597. | SGSDI |
| 7598. | GSDIP |
| 7599. | SDIPI |
| 7600. | DIPIV |
| 7601. | IPIVG |
| 7602. | PIVGP |
| 7603. | IVGPS |
| 7604. | VGPSG |
| 7605. | GPSGS |
| 7606. | PSGSA |
| 7607. | SGSAA |
| 7608. | GSAAS |
| 7609. | SAASA |
| 7610. | AASAG |
| 7611. | ASAGS |
| 7612. | SAGSA |
| 7613. | AGSAV |
| 7614. | GSAVG |
| 7615. | SAVGA |
| 7616. | AVGAL |
| 7617. | VGALK |
| 7618. | GALKS |
| 7619. | ALKSS |
| 7620. | LKSSN |
| 7621. | KSSNN |
| 7622. | SSNNS |
| 7623. | SNNSG |
| 7624. | NNSGR |
| 7625. | NSGRI |
| 7626. | SGRIS |
| 7627. | GRISL |
| 7628. | RISLL |
| 7629. | ISLLL |
| 7630. | SLLLD |
| 7631. | LLLDD |
| 7632. | LLDDV |
| 7633. | LDDVD |

TABLE 6-continued

| | |
|---|---|
| 7634. | DDVDN |
| 7635. | DVDNE |
| 7636. | VDNEM |
| 7637. | DNEMA |
| 7638. | NEMAA |
| 7639. | EMAAI |
| 7640. | MAAIA |
| 7641. | AAIAM |
| 7642. | AIAMQ |
| 7643. | IAMQG |
| 7644. | AMQGF |
| 7645. | MQGFR |
| 7646. | QGFRS |
| 7647. | GFRSM |
| 7648. | FRSMI |
| 7649. | RSMIE |
| 7650. | SMIEQ |
| 7651. | MIEQF |
| 7652. | IEQFN |
| 7653. | EQFNV |
| 7654. | QFNVN |
| 7655. | FNVNN |
| 7656. | NVNNP |
| 7657. | VNNPA |
| 7658. | NNPAT |
| 7659. | NPATA |
| 7660. | PATAK |
| 7661. | ATAKE |
| 7662. | TAKEL |
| 7663. | AKELQ |
| 7664. | KELQA |
| 7665. | ELQAM |
| 7666. | LQAME |
| 7667. | QAMEA |
| 7668. | AMEAQ |
| 7669. | MEAQL |
| 7670. | EAQLT |
| 7671. | AQLTA |
| 7672. | QLTAM |
| 7673. | LTAMS |
| 7674. | TAMSD |
| 7675. | AMSDQ |
| 7676. | MSDQL |
| 7677. | SDQLV |
| 7678. | DQLVG |
| 7679. | QLVGA |
| 7680. | LVGAD |
| 7681. | VGADG |
| 7682. | GADGE |
| 7683. | ADGEL |
| 7684. | DGELP |
| 7685. | GELPA |
| 7686. | ELPAE |
| 7687. | LPAEI |
| 7688. | PAEIQ |
| 7689. | AEIQA |
| 7690. | EIQAI |
| 7691. | IQAIK |
| 7692. | QAIKD |
| 7693. | AIKDA |
| 7694. | IKDAL |
| 7695. | KDALA |
| 7696. | DALAQ |
| 7697. | ALAQA |
| 7698. | LAQAL |
| 7699. | AQALK |
| 7700. | QALKQ |
| 7701. | ALKQP |
| 7702. | LKQPS |
| 7703. | KQPST |
| 7704. | QPSTD |
| 7705. | PSTDG |
| 7706. | STDGL |
| 7707. | TDGLA |
| 7708. | DGLAT |
| 7709. | GLATA |
| 7710. | LATAM |
| 7711. | ATAMG |
| 7712. | TAMGQ |
| 7713. | AMGQV |

TABLE 6-continued

| | |
|---|---|
| 7714. | MGQVA |
| 7715. | GQVAF |
| 7716. | QVAFA |
| 7717. | VAFAA |
| 7718. | AFAAA |
| 7719. | FAAAK |
| 7720. | AAAKV |
| 7721. | AAKVG |
| 7722. | AKVGG |
| 7723. | KVGGG |
| 7724. | VGGGS |
| 7725. | GGGSA |
| 7726. | GGSAG |
| 7727. | GSAGT |
| 7728. | SAGTA |
| 7729. | AGTAG |
| 7730. | GTAGT |
| 7731. | TAGTV |
| 7732. | AGTVQ |
| 7733. | GTVQM |
| 7734. | TVQMN |
| 7735. | VQMNV |
| 7736. | QMNVK |
| 7737. | MNVKQ |
| 7738. | NVKQL |
| 7739. | VKQLY |
| 7740. | KQLYK |
| 7741. | QLYKT |
| 7742. | LYKTA |
| 7743. | YKTAF |
| 7744. | KTAFS |
| 7745. | TAFSS |
| 7746. | AFSST |
| 7747. | FSSTS |
| 7748. | SSTSS |
| 7749. | STSSS |
| 7750. | TSSSS |
| 7751. | SSSSY |
| 7752. | SSSYA |
| 7753. | SSYAA |
| 7754. | SYAAA |
| 7755. | YAAAL |
| 7756. | AAALS |
| 7757. | AALSD |
| 7758. | ALSDG |
| 7759. | LSDGY |
| 7760. | SDGYS |
| 7761. | DGYSA |
| 7762. | GYSAY |
| 7763. | YSAYK |
| 7764. | SAYKT |
| 7765. | AYKTL |
| 7766. | YKTLN |
| 7767. | KTLNS |
| 7768. | TLNSL |
| 7769. | LNSLY |
| 7770. | NSLYS |
| 7771. | SLYSE |
| 7772. | LYSES |
| 7773. | YSESR |
| 7774. | SESRS |
| 7775. | ESRSG |
| 7776. | SRSGV |
| 7777. | RSGVQ |
| 7778. | SGVQS |
| 7779. | GVQSA |
| 7780. | VQSAI |
| 7781. | QSAIS |
| 7782. | SAISQ |
| 7783. | AISQT |
| 7784. | ISQTA |
| 7785. | SQTAN |
| 7786. | QTANP |
| 7787. | TANPA |
| 7788. | ANPAL |
| 7789. | NPALS |
| 7790. | PALSR |
| 7791. | ALSRS |
| 7792. | LSRSV |
| 7793. | SRSVS |
| 7794. | RSVSR |
| 7795. | SVSRS |
| 7796. | VSRSG |
| 7797. | SRSGI |
| 7798. | RSGIE |
| 7799. | SGIES |
| 7800. | GIESQ |
| 7801. | IESQG |
| 7802. | ESQGR |
| 7803. | SQGRS |
| 7804. | QGRSA |
| 7805. | GRSAD |
| 7806. | RSADA |
| 7807. | SADAS |
| 7808. | ADASQ |
| 7809. | DASQR |
| 7810. | ASQRA |
| 7811. | SQRAA |
| 7812. | QRAAE |
| 7813. | RAAET |
| 7814. | AAETI |
| 7815. | AETIV |
| 7816. | ETIVR |
| 7817. | TIVRD |
| 7818. | IVRDS |
| 7819. | VRDSQ |
| 7820. | RDSQT |
| 7821. | DSQTL |
| 7822. | SQTLG |
| 7823. | QTLGD |
| 7824. | TLGDV |
| 7825. | LGDVY |
| 7826. | GDVYS |
| 7827. | DVYSR |
| 7828. | VYSRL |
| 7829. | YSRLQ |
| 7830. | SRLQV |
| 7831. | RLQVL |
| 7832. | LQVLD |
| 7833. | QVLDS |
| 7834. | VLDSL |
| 7835. | LDSLM |
| 7836. | DSLMS |
| 7837. | SLMST |
| 7838. | LMSTI |
| 7839. | MSTIV |
| 7840. | STIVS |
| 7841. | TIVSN |
| 7842. | IVSNP |
| 7843. | VSNPQ |
| 7844. | SNPQV |
| 7845. | NPQVN |
| 7846. | PQVNQ |
| 7847. | QVNQE |
| 7848. | VNQEE |
| 7849. | NQEEI |
| 7850. | QEEIM |
| 7851. | EEIMQ |
| 7852. | EIMQK |
| 7853. | IMQKL |
| 7854. | MQKLT |
| 7855. | QKLTA |
| 7856. | KLTAS |
| 7857. | LTASI |
| 7858. | TASIS |
| 7859. | ASISK |
| 7860. | SISKA |
| 7861. | ISKAP |
| 7862. | SKAPQ |
| 7863. | KAPQF |
| 7864. | APQFG |
| 7865. | PQFGY |
| 7866. | QFGYP |
| 7867. | FGYPA |
| 7868. | GYPAV |
| 7869. | YPAVQ |
| 7870. | PAVQN |
| 7871. | AVQNS |
| 7872. | VQNSA |
| 7873. | QNSAD |

TABLE 6-continued

| | |
|---|---|
| 7874. | NSADS |
| 7875. | SADSL |
| 7876. | ADSLQ |
| 7877. | DSLQK |
| 7878. | SLQKF |
| 7879. | LQKFA |
| 7880. | QKFAA |
| 7881. | KFAAQ |
| 7882. | FAAQL |
| 7883. | AAQLE |
| 7884. | AQLER |
| 7885. | QLERE |
| 7886. | LEREF |
| 7887. | EREFV |
| 7888. | REFVD |
| 7889. | EFVDG |
| 7890. | FVDGE |
| 7891. | VDGER |
| 7892. | DGERS |
| 7893. | GERSL |
| 7894. | ERSLA |
| 7895. | RSLAE |
| 7896. | SLAES |
| 7897. | LAESR |
| 7898. | AESRE |
| 7899. | ESREN |
| 7900. | SRENA |
| 7901. | RENAF |
| 7902. | ENAFR |

TABLE 6-continued

| | |
|---|---|
| 7903. | NAFRK |
| 7904. | AFRKQ |
| 7905. | FRKQP |
| 7906. | RKQPA |
| 7907. | KQPAF |
| 7908. | QPAFI |
| 7909. | PAFIQ |
| 7910. | AFIQQ |
| 7911. | FIQQV |
| 7912. | IQQVL |
| 7913. | QQVLV |
| 7914. | QVLVN |
| 7915. | VLVNI |
| 7916. | LVNIA |
| 7917. | VNIAS |
| 7918. | NIASL |
| 7919. | IASLF |
| 7920. | ASLFS |
| 7921. | SLFSG |
| 7922. | LFSGY |
| 7923. | FSGYL |
| 7924. | SGYLS |

Amino Acid Sequences of *Chlamydia trachomatis* Proteins CT443, CT381, CT875, CT147, HSP60, CT376 and CT557, CT858 (CPAF), Pgp3, CT823 (cHtrA), CT681 (14014P), CT119 (IncA) and CT813 (All sequences are available from this website: www.ncbi.nlm.nih.gov/protein/15605169)

CT443 (OmcB or CRP60, 553 amino acids), ACCESSION#: NP 219955.1, GI: 15605169
(SEQ ID NO: 7925)

```
  1 mrigdpmnkl irravtifav tsvaslfasg vletsmaesl stnvisladt kakdntshks
 61 kkarknhske tpvdrkevap vheskatgpk qdscfgrmyt vkvnddrnve itqavpeyat
121 vgspypieit atgkrdcvdv iitqqlpcea efvrsdpatt ptadgklvwk idrlgqgeks
181 kitvwvkplk egccftaatv cacpeirsvt kcgqpaicvk qegpenaclr cpvvykiniv
241 nqgtatarnv vvenpvpdgy ahssgqrvlt ftlgdmqpge hrtitvefcp lkrgratnia
301 tvsycgghkn tasvttvine pcvqvsiaga dwsyvckpve yvisvsnpgd lvlrdvvved
361 tlspgvtvle aagaqiscnk vvwtvkelnp geslqykylv raqtpgqftn nvvvkscsdc
421 gtctscaeat tywkgvaath mcvvdtcdpv cvgentvyri cvtnrgsaed tnvslmlkfs
481 kelqpvsfsg ptkgtitgnt vvfdslprlg sketvefsvt lkavsagdar geailssdtl
541 tvpvsdtent hiy
```

CT381 (ArtJ, 257 amino acids), ACCESSION# NP 219890.1, GI: 15605105
(SEQ ID NO: 7926)

```
  1 mcikrkktwi aflavvcsfc ltgclkeggd snsekfivgt natyppfefv dkrgevvgfd
 61 idlareisnk lgktldvref sfdalilnlk qhridavitg msitpsrlke ilmipyygee
121 ikhlvlvfkg enkhplpltq yrsvavqtgt ygeaylqsls evhirsfdst levlmevmhg
181 kspvavleps iaqvvlkdfp alstatidlp edqwvlgygi gvasdrpala lkieaavqei
241 rkegvlaele qkwglnn
```

CT875 (hypothetical protein, 591 amino acids), ACCESSION#: NP 219502.1, GI: 15604718
(SEQ ID NO: 7927)

```
  1 msirgvggng nsripshngd gsnrrsqntk gnnkvedrvc slyssrsnen respyavvdv
 61 ssmiestpts gettrasrgv fsrfqrglvr vadkvrravq cawssystrr ssatraaesg
121 sssrtargas sgyreyspsa arglrlmftd fwrtrylrqt spmagvfgnl dvnearlmaa
181 ytsecadhle anklagpdgv aaareiakrw eqrvrdlqdk gaarkllndp lgrrtpnyqs
241 knpgeytvgn smfydgpqva nlqnvdtgfw ldmsnlsdvv lsreiqtglr aratleesmp
```

-continued

```
301 mlenleerfr rlqetcdaar teieesgwtr esasrmegde aqgpsraqqa fqsfvnecns 361 iefsfgsfge hvrvlcarvs rglaaageai rrcfscckgs thryaprddl spegaslaet 421 larfaddmgi ergadgtydi plvddwrrgv psiegegsds iyeimmpiye vmdmdletrr 481 sfavqqghyq dprasdydlp rasdydlprs pyptpplppr yqlqnmdvea gfreavyasf 541 vagmynyvvt qpqeripnsq qvegilrdml tngsqtfrdl mrrwnrevdr e
```

CT147 (hypothetical protein, 1449 amino acids), ACCESSION# NP 219650.1,
GI: 15604866

(SEQ ID NO: 7928)

```
   1 manpstpsfn hsdlslqgrl rassqqctqa gqgdpqplsp esrgltsnfs trrdlidvve 61 esietakgse lkklriyeia lkiltiigaa ilfavplcml lgvplwipiv tcigvgiafs 121 iakgclqkrc qqireeyral hlyhryllsn kdsidgtlls rfdirfrkae eklhgldldk 181 reanhplead krydfaglah qryqvdaalg isssqdafwr gvaqqvksvk ddvvlgdkas 241 tdlypiaqqa lqaagvgfsg aagkeslldl akslsslfaw gsqvgkdshe alqqyqmrfl 301 sspilatwcg agfsasaqdf vlkgenildi asenhtkmqn aikrvqlvsv lgkmrnwkek 361 idtliqnknl dqdslrklyq diekamhkvc iedgvstsiq tqvrkvtqky lrqdlqelln 421 kkaplnesdl skmqkgissc anlvvtlles qlgtsgqtpi keveesiyrd liatilqmgs 481 aaggvtplvd gvhkairegk alrselsram slhprqsflg vqsaveklqa firdpkwgas 541 avhtsaeetl aqkqkfvsdl triqtsladw reryglfeet klnhivstdf vsrteafldt 601 lknvaeacsl eqavaelkdc edamkadlth veqkmnptei esareefkrl meelagiqeq 661 leqiaqpiye egvsgerlll ntvffhpevl rkkvqakeas lealtkgeqp sptkkktlkq 721 lsegceyfss lvskinalkt ilegsrgkki asqdirqlig ltdelalels sfqqdslesl 781 lygleglsip aasieqkkgs pksssiaekv vyashqrvhn gvkakvnrtl eafsqlikgl 841 rgslrnamit kavvaavlsv afsclaialf svqltwlpim lcvlalvlea ipsalsiwve 901 krnwkyevas lakqlvsdgr klpypdlgdq nikhlekird vygldgvael rvaeaallgv 961 qklpeeqkqe slksavkalr adakvlnkkf kklpesyqpq hsevtgvqgv teqesrddvl 1021 vaqdmaaiee lqdqyhaacl qfesystrfl aeqrkakfle ellvqkrrdv shlshqeahy 1081 tqvvshlkel ismrkgastq haskeeistk mrellslddq llkahtaqdv nrdnsingql 1141 qqqfkklsee gslqkvkall elnmclgnag qtlyhsrlkr evfeaslsgt srqllqyged 1201 lfasydgsdr sallrfvlgs gyemiseass elkslrkrwk rsasqaaiap edyekvcrvl 1261 erflkardsl rpklglplgk ssdatvglqh qirdnqrvka rvtacyqesc rnvlqhledw 1321 vrktrqesae cqkvetkire fcqkagsken laestemlfs sleedlnkip ldvlrailrs 1381 lsskvlhird qklelekleee qfaktnaivk akeaefekng evwhnqyqml ksqmeklesq 1441 krrltdkke
```

HSP60 (CT110, 544 amino acids), ACCESSION# AAS19616.1, GI: 42541742

(SEQ ID NO: 7929)

```
   1 mvaknikyne earkkiqkgv ktlaeavkvt lgpkgrhvvi dksfgspqvt kdgvtvakev 61 eladkhenmg aqmvkevask tadkagdgtt tatvlaeaiy teglrnvtag anpmdlkrgi 121 dkavkvvvdq irkiskpvqh hkeiaqvati sanndaeign liaeamekvg kngsitveea 181 kgfetvldvv egmnfnrgyl ssyfatnpet qecvledalv liydkkisgi kdflpvlqqv 241 aesgrplli aediegeala tivvnrirgg frvcavkapg fgdrrkamle diailtggql 301 iseelgmkle nanlamlgka kkvivskedt tivegmgeke alearcesik kqiedsssdy 361 dkeklqerla klsggvavir vgaateiemk ekkdrvddaq hatiaaveeg ilpggggtali 421 rciptleafl pmltnedeqi garivlkals aplkqiaana gkegaiifqq vmsrsanegy
```

```
481 dalrdaytdm leagildpak vtrsalesaa svagllltte aliaeipeek paaapampga 541 gmdy
```

CT376 (malate dehydrogenase, 326 amino acids) ACCESSION# NP 219885.1, GI: 15605100

(SEQ ID NO: 7930)

```
  1 mvsqtvsvav tggtgqiays flfslahgdv fgldcgidlr iydipgtera lsgvrmeldd 61 gafpllqrvq vttslhdafd gidaafligs vprgpgmerr dllkkngeif atqgkalntt 121 akrdakifvv gnpvntncwi amnhaprllr knfhamlrld qnrmhsmlsh raevplsavs 181 qvvvwgnhsa kqvpdftqal indrpiaeti adrdwlenim vpsvqsrgsa vieargkssa 241 asaaralaea arsiyqpkeg ewfssgvcsd hnpyglpedl ifgfpcrmla tgeyeviprl 301 pwdafirgkm qisldeilqe kasvsl
```

CT557 (dihydrolipoamide dehydrogenase, 465 amino acids), ACCESSION# NP 220072.1, GI: 15605286

(SEQ ID NO: 7931)

```
  1 mneafdcvvi gagpggyvaa itaaqaglkt aliekreagg tclnrgcips kallagaevv 61 tqirhadqfg ihvegfsiny pamvqrkdsv vrsirdglng lirsnkitvf sgrgslisst 121 evkilgenps vikahsiila tgseprafpg ipfsaespri lcstgvlnlk eipqkmaiig 181 ggvigcefas lfhtlgsevs vieassqila lnnpdisktm fdkftrqglr fvleasysni 241 edigdrvrlt ingnveeydy vlvsigrrin tenigldkag vicdergvip tdatmrtnvp 301 niyaigditg kwqlahvash qgiiaarnia ghkeeidysa vpsviftfpe vasvglspta 361 aqqqkipvkv tkfpfraigk avamgeadgf aaiishettq qilgayvigp hassliseit 421 lavrneltlp ciyetihahp tlaevwaesa llavdtplhm ppakk
```

CT858 (CPAF, total of 609 amino acids), ACCESSION# AAC68456.1, GI: 3329332

(SEQ ID NO: 7932)

```
  1 mgfwrtsimk mnriwllllt fssaihspvq geslvcknal qdlsflehll qvkyapktwk 61 eqylgwdlvq ssysaqqklr tqenpstsfc qqvladfigg lndfhagvtf faiesaylpy 121 tvqkssdgrf yfvdimtfss eirvgdelle vdgapvqdvl atlygsnhkg taaeesaalr 181 tlfsrmaslg hkvpsgrttl kirrpfgttr evrvkwryvp egvgdlatia psirapqlqk 241 smrsffpkkd dafhrssslf yspmvphfwa elrnhyatsg lksgynigst dgflpvigpv 301 iweseglfra yissvtdgdg kshkvgflri ptyswqdmed fdpsgpppwe efakiiqvfs 361 sntealiidq tnnpggsvly lyallsmltd rplelpkhrm iltqdevvda ldwltllenv 421 dtnvesrlal gdnmegytvd lqvaeylksf grqvincwsk gdielstpip lfgfekihph 481 prvqyskpic vlineqdfsc adffpvvlkd ndralivgtr tagaggfvfn vqfpnrtgik 541 tcsltgslav rehgafieni gvephidlpf tandirykgy seyldkvkkl vcqlinndgt 601 iilaedgsf
```

Pgp3 (plasmid-encoded secretion protein, 264 amino acids), ACCESSION# ADI51551.1, GI: 297749006

(SEQ ID NO: 7933)

```
  1 mgnsgfylyn tencvfadni kvgqmteplk dqqiilgtks tpvaakmtas dgisltvsnn 61 sstnasitig ldaekayqli leklgnqild giadtivdst vqdildkitt dpslgllkaf 121 nnfpitnkiq cnglftpsni etllggteig kftvtpkssg smflvsadii asrmeggvvl 181 alvregdskp caisygyssg vpnlcslrts itntgltptt yslrvggles gvvwvnalsn 241 gndilgitnt snvsflevip qtna
```

CT823 (cHtrA, 497 amino acids), ACCESSION# NP 220344.1, GI: 15605558

(SEQ ID NO: 7934)

```
  1 mmkrllcvll stsvfsspml gysaskkdsk adiclavssg dgevsgedll kevsrgfsrv 61 aakatpgvvy ienfpktgnq aiaspgnkrg fqenpfdyfn deffnrffgl pshreqqrpq
```

```
121 qrdavrgtgf ivsedgyvvt nhhvvedagk ihvtlhdgqk ytakivgldp ktdlavikiq 181 aeklpfltfg nsdqlqigdw aiaignpfgl qatvtvgvis akgrnqlhiv dfedfiqtda 241 ainpgnsggp llningqvig vntaivsgsg gyigigfaip slmakrvidq lisdgqvtrg 301 flgvtlqpid selatcykle kvygalvtdv vkgspaekag lrqedvivay ngkeveslsa 361 lrnaislmmp gtrvvlkivr egktieipvt vtqiptedgv salqkmgvrv qnitpeickk 421 lglaadtrgi lvvaveagsp aasagvapgq lilavnrqrv asveelnqvl knskgenvll 481 mvsqgdvvrf ivlksde
```

CT681 (MOMP, 393 amino acids), ACCESSION# NP 220200.1, GI: 15605414
(SEQ ID NO: 7935)
```
  1 mkkllksvlv faalssassl qalpvgnpae pslmidgilw egfggdpcdp catwcdaism 61 rvgyygdfvf drvlktdvnk efqmgakptt dtgnsaapst ltarenpayg rhmqdaemft 121 naacmalniw drfdvfctlg atsgylkgns asfnlvglfg dnenqktvka esvpnmsfdq 181 svvelytdtt fawsvgaraa lwecgcatlg asfqyaqskp kveelnvlcn aaeftinkpk 241 gyvgkefpld ltagtdaatg tkdasidyhe wqaslalsyr lnmftpyigv kwsrasfdad 301 tiriaqpksa taifdttlln ptiagagdvk tgaegqlgdt mqivslqlnk mksrkscgia 361 vgttivdadk yavtvetrli deraahvnaq frf
```

CT119 (IncA, 273 amino acids), ACCESSION# NP 219622.1, GI: 15604838
(SEQ ID NO: 7936)
```
  1 mttptlivtp psppapsysa nrvpqpslmd kikkiaaias liligtigfl allghlvgfl 61 iapqitivll alfiislagn alylqktanl hlyqdlqrev gslkeinfml svlqkeflhl 121 skefattskd lsavsqdfys clqgfrdnyk gfeslldeyk nsteemrklf sqeiiadlkg 181 svaslreeir fltplaeevr rlahnqqslt vvieelktir dslrdeigql sqlsktltsq 241 ialqrkessd lcsqiretls sprksaspst kss
```

CT813 (inclusion membrane protein, 264 amino acids), ACCESSION#
NP 220333.1, GI: 15605547
(SEQ ID NO: 7937)
```
  1 mttlpnncts nsnsintftk diemakqiqg srkdplakts wiaglicvva gvlgllaigi 61 ggcsmasglg ligaivaavi vavglcclvs alclqveksq wwqkefeswi eqksqfrivm 121 admlkanrkl qseveflskg wsddtavhke dvtkyeqvve eyaekimely eetgvltiek 181 inlqkekkaw leekaemeqk lttvtdleaa kqqleekvtd lesekqelre eldkaienld 241 emayeamefe kekhgikpgr rgsi
```

CT795 (hypothetical protein, 163 amino acids), ACCESSION# NP 220315.1,
GI: 15605529
(SEQ ID NO: 7938)
```
  1 mrfllalfsl ilvlpateaf stedkqcqqe aeedcsqvad tcvfysyaeg lehardegkl 61 tivvlldtsg ysfetladaa hamessllst fadfvvlsrr eavpliyppv pdpmvgeial 121 fleafsdqtf psqpvivtla igassaeimd iteipsinpe fve
```

CT621 (hypothetical protein, 832 amino acids), ACCESSION# NP 220138.1,
GI: 15605352
(SEQ ID NO: 7939)
```
  1 mnrihrtqgs ltdynstlea iakkiakpds ativsqvaqy eqfkmeqeal kallvsfdqk 61 adqryrnliq rleqldvdrq tgrstesqhi qekpmaslqs enqvvaqavv qsdssmpift 121 gikqswavrl vqgireildq vlvdtslfte eergdllair mdaaslqdkq erlstedirs 181 llslsndvmr vlqkasysst rqleliqsli difgteenle qsfaqvrlen fqailsvike 241 rlteeefrvf qevseeissi qrtseshlsp ehieaiarvg ghlsakives elkasqkvdl 301 cqriaamyqe qvdavqayhs leqdalfvns rqhshfvqvi slvsslmhsl sptseeeril 361 lnpammvsvl ptvraiglrf dfltaeqqqm vnaavsslqq qqldeflgvl cahlvvvncq
```

```
421 nketgllegl eesfsetlsg lsnnfvltak mqdilqvcsl qgfvtlangd ryelfsynds 481 geavcdeial gdgfhkvlgt mlavalsqae vfkqecdrfi lqadseknmi hkrmvqgeqk 541 slfltkmqte lnagktiaqt keveasplps avasvlidhy mpkeveflek issrlyygnk 601 gsdigntild aislyvnsat yfgfanyigq ppvvgktren ifagsadnak akldeekkqv 661 dvfleiteaa kttvtnqqsa vtnddklste qkakikaelt qytdmlnais nsltslktql 721 aplsvstveg vdgvfevkng ipgengknwr lvlqtledtv vsgevgsptn igmfqmqalv 781 hlnqqayadm gqnfqlelqm hltsmqqewm vvatslqlln qiylglarnl lr CT622 (hypothetical protein, 647 amino acids), ACCESSION# NP 220139.1,
GI: 15605353
                                                    (SEQ ID NO: 7940)
  1 mesgpesyss nqssmnpiin gqiasnsetk estkeseasp sasssvssws flssakhali 61 slrdailnkn ssptdslsql eastststvt rvaardynea ksnfdtaksg lenattlaey 121 etkmadlmaa lqdmerlakq kaevtrikea lqekqevidk lnqlvklekq nqtlketltt 181 tdsadqipai nsqleinkns adqiikdleg qnisyeavlt nagevikass eagiklgqal 241 qsivdagdqs qaavlqaqqn nspdniaatk klidaaetkv nelkqehtgl tdsplvkkae 301 eqisqaqkdi qeikpsgsdi pivgpsgsaa sagsavgalk ssnnsgrisl llddvdnema 361 aiamqgfrsm ieqfnvnnpa takelqamea qltamsdqlv gadgelpaei qaikdalaqa 421 lkqpstdgla tamgqvafaa akvgggsagt agtvqmnvkq lyktafssts sssyaaalsd 481 gysayktlns lysesrsgvq saisqtanpa lsrsysrsgi esqgrsadas qraaetivrd 541 sqtlgdvysr lqvldslmst ivsnpqvnqe eimqkltasi skapqfgypa vqnsadslqk 601 faaqlerefv dgerslaesr enafrkqpaf iqqvlvnias lfsgyls
```

SEQUENCE LISTING (7940 sequences)

SEQ ID NO: 1 - protein, 5 aa, Chlamydia trachomatis
MRIGD

SEQ ID NO: 2 - protein, 5 aa, Chlamydia trachomatis
RIGDP

SEQ ID NO: 3 - protein, 5 aa, Chlamydia trachomatis
IGDPM

SEQ ID NO: 4 - protein, 5 aa, Chlamydia trachomatis
GDPMN

SEQ ID NO: 5 - protein, 5 aa, Chlamydia trachomatis
DPMNK

SEQ ID NO: 6 - protein, 5 aa, Chlamydia trachomatis
PMNKL

SEQ ID NO: 7 - protein, 5 aa, Chlamydia trachomatis
MNKLI

SEQ ID NO: 8 - protein, 5 aa, Chlamydia trachomatis
NKLIR

SEQ ID NO: 9 - protein, 5 aa, Chlamydia trachomatis
KLIRR

SEQ ID NO: 10 - protein, 5 aa, Chlamydia trachomatis
LIRRA

SEQ ID NO: 11 - protein, 5 aa, Chlamydia trachomatis
IRRAV

SEQ ID NO: 12 - protein, 5 aa, Chlamydia trachomatis
RRAVT

SEQ ID NO: 13 - protein, 5 aa, Chlamydia trachomatis
RAVTI

SEQ ID NO: 14 - protein, 5 aa, Chlamydia trachomatis
AVTIF

SEQ ID NO: 15 - protein, 5 aa, Chlamydia trachomatis
VTIFA

SEQ ID NO: 16 - protein, 5 aa, Chlamydia trachomatis
TIFAV

SEQ ID NO: 17 - protein, 5 aa, Chlamydia trachomatis
IFAVT

SEQ ID NO: 18 - protein, 5 aa, Chlamydia trachomatis
FAVTS

SEQ ID NO: 19 - protein, 5 aa, Chlamydia trachomatis
AVTSV

SEQ ID NO: 20 - protein, 5 aa, Chlamydia trachomatis
VTSVA

SEQ ID NO: 21 - protein, 5 aa, Chlamydia trachomatis
TSVAS

SEQ ID NO: 22 - protein, 5 aa, Chlamydia trachomatis
SVASL

SEQ ID NO: 23 - protein, 5 aa, Chlamydia trachomatis
VASLF

SEQ ID NO: 24 - protein, 5 aa, Chlamydia trachomatis
ASLFA

SEQ ID NO: 25 - protein, 5 aa, Chlamydia trachomatis
SLFAS

SEQ ID NO: 26 - protein, 5 aa, Chlamydia trachomatis
LFASG

SEQ ID NO: 27 - protein, 5 aa, Chlamydia trachomatis
FASGV

SEQ ID NO: 28 - protein, 5 aa, Chlamydia trachomatis
ASGVL

SEQ ID NO: 29 - protein, 5 aa, Chlamydia trachomatis
SGVLE

SEQ ID NO: 30 - protein, 5 aa, Chlamydia trachomatis
GVLET

SEQ ID NO: 31 - protein, 5 aa, Chlamydia trachomatis
VLETS

SEQ ID NO: 32 - protein, 5 aa, Chlamydia trachomatis
LETSM

SEQ ID NO: 33 - protein, 5 aa, Chlamydia trachomatis
ETSMA

SEQ ID NO: 34 - protein, 5 aa, Chlamydia trachomatis
TSMAE

SEQ ID NO: 35 - protein, 5 aa, Chlamydia trachomatis
SMAES

SEQ ID NO: 36 - protein, 5 aa, Chlamydia trachomatis
MAESL

SEQ ID NO: 37 - protein, 5 aa, Chlamydia trachomatis
AESLS

SEQ ID NO: 38 - protein, 5 aa, Chlamydia trachomatis
ESLST

SEQ ID NO: 39 - protein, 5 aa, Chlamydia trachomatis
SLSTN

SEQ ID NO: 40 - protein, 5 aa, Chlamydia trachomatis
YATVG

SEQ ID NO: 41 - protein, 5 aa, Chlamydia trachomatis
STNVI

SEQ ID NO: 42 - protein, 5 aa, Chlamydia trachomatis
TNVIS

SEQ ID NO: 43 - protein, 5 aa, Chlamydia trachomatis
NVISL

SEQ ID NO: 44 - protein, 5 aa, Chlamydia trachomatis
VISLA

SEQ ID NO: 45 - protein, 5 aa, Chlamydia trachomatis
ISLAD

SEQ ID NO: 46 - protein, 5 aa, Chlamydia trachomatis
SLADT

SEQ ID NO: 47 - protein, 5 aa, Chlamydia trachomatis
LADTK

SEQ ID NO: 48 - protein, 5 aa, Chlamydia trachomatis
ADTKA

SEQ ID NO: 49 - protein, 5 aa, Chlamydia trachomatis
DTKAK

SEQ ID NO: 50 - protein, 5 aa, Chlamydia trachomatis
TKAKD

SEQ ID NO: 51 - protein, 5 aa, Chlamydia trachomatis
KAKDN

SEQ ID NO: 52 - protein, 5 aa, Chlamydia trachomatis
AKDNT

SEQ ID NO: 53 - protein, 5 aa, Chlamydia trachomatis
KDNTS

SEQ ID NO: 54 - protein, 5 aa, Chlamydia trachomatis
DNTSH

SEQ ID NO: 55 - protein, 5 aa, Chlamydia trachomatis
NTSHK

SEQ ID NO: 56 - protein, 5 aa, Chlamydia trachomatis
TSHKS

SEQ ID NO: 57 - protein, 5 aa, Chlamydia trachomatis
SHKSK

SEQ ID NO: 58 - protein, 5 aa, Chlamydia trachomatis
HKSKK

SEQ ID NO: 59 - protein, 5 aa, Chlamydia trachomatis
KSKKA

SEQ ID NO: 60 - protein, 5 aa, Chlamydia trachomatis
SKKAR

SEQ ID NO: 61 - protein, 5 aa, Chlamydia trachomatis
KKARK

SEQ ID NO: 62 - protein, 5 aa, Chlamydia trachomatis
KARKN

SEQ ID NO: 63 - protein, 5 aa, Chlamydia trachomatis
ARKNH

SEQ ID NO: 64 - protein, 5 aa, Chlamydia trachomatis
RKNHS

SEQ ID NO: 65 - protein, 5 aa, Chlamydia trachomatis
KNHSK

SEQ ID NO: 66 - protein, 5 aa, Chlamydia trachomatis
NHSKE

SEQ ID NO: 67 - protein, 5 aa, Chlamydia trachomatis
HSKET

SEQ ID NO: 68 - protein, 5 aa, Chlamydia trachomatis
SKETP

SEQ ID NO: 69 - protein, 5 aa, Chlamydia trachomatis
KETPV

SEQ ID NO: 70 - protein, 5 aa, Chlamydia trachomatis
ETPVD

SEQ ID NO: 71 - protein, 5 aa, Chlamydia trachomatis
TPVDR

SEQ ID NO: 72 - protein, 5 aa, Chlamydia trachomatis
PVDRK

SEQ ID NO: 73 - protein, 5 aa, Chlamydia trachomatis
VDRKE

SEQ ID NO: 74 - protein, 5 aa, Chlamydia trachomatis
DRKEV

SEQ ID NO: 75 - protein, 5 aa, Chlamydia trachomatis
RKEVA

SEQ ID NO: 76 - protein, 5 aa, Chlamydia trachomatis
KEVAP

SEQ ID NO: 77 - protein, 5 aa, Chlamydia trachomatis
EVAPV

SEQ ID NO: 78 - protein, 5 aa, Chlamydia trachomatis
VAPVH

SEQ ID NO: 79 - protein, 5 aa, Chlamydia trachomatis
APVHE

SEQ ID NO: 80 - protein, 5 aa, Chlamydia trachomatis
PVHES

SEQ ID NO: 81 - protein, 5 aa, Chlamydia trachomatis
TTPTA

SEQ ID NO: 82 - protein, 5 aa, Chlamydia trachomatis
HESKA

SEQ ID NO: 83 - protein, 5 aa, Chlamydia trachomatis
ESKAT

SEQ ID NO: 84 - protein, 5 aa, Chlamydia trachomatis
SKATG

SEQ ID NO: 85 - protein, 5 aa, Chlamydia trachomatis
KATGP

SEQ ID NO: 86 - protein, 5 aa, Chlamydia trachomatis
ATGPK

SEQ ID NO: 87 - protein, 5 aa, Chlamydia trachomatis
TGPKQ

SEQ ID NO: 88 - protein, 5 aa, Chlamydia trachomatis
GPKQD

SEQ ID NO: 89 - protein, 5 aa, Chlamydia trachomatis
PKQDS

SEQ ID NO: 90 - protein, 5 aa, Chlamydia trachomatis
KQDSC

SEQ ID NO: 91 - protein, 5 aa, Chlamydia trachomatis
QDSCF

SEQ ID NO: 92 - protein, 5 aa, Chlamydia trachomatis
DSCFG

SEQ ID NO: 93 - protein, 5 aa, Chlamydia trachomatis
SCFGR

SEQ ID NO: 94 - protein, 5 aa, Chlamydia trachomatis
CFGRM

SEQ ID NO: 95 - protein, 5 aa, Chlamydia trachomatis
FGRMY

SEQ ID NO: 96 - protein, 5 aa, Chlamydia trachomatis
GRMYT

SEQ ID NO: 97 - protein, 5 aa, Chlamydia trachomatis
RMYTV

SEQ ID NO: 98 - protein, 5 aa, Chlamydia trachomatis
MYTVK

SEQ ID NO: 99 - protein, 5 aa, Chlamydia trachomatis
YTVKV

SEQ ID NO: 100 - protein, 5 aa, Chlamydia trachomatis
TVKVN

SEQ ID NO: 101 - protein, 5 aa, Chlamydia trachomatis
VKVND

SEQ ID NO: 102 - protein, 5 aa, Chlamydia trachomatis
KVNDD

SEQ ID NO: 103 - protein, 5 aa, Chlamydia trachomatis
VNDDR

SEQ ID NO: 104 - protein, 5 aa, Chlamydia trachomatis
NDDRN

SEQ ID NO: 105 - protein, 5 aa, Chlamydia trachomatis
DDRNV

SEQ ID NO: 106 - protein, 5 aa, Chlamydia trachomatis
DRNVE

SEQ ID NO: 107 - protein, 5 aa, Chlamydia trachomatis
RNVEI

SEQ ID NO: 108 - protein, 5 aa, Chlamydia trachomatis
NVEIT

SEQ ID NO: 109 - protein, 5 aa, Chlamydia trachomatis
VEITQ

SEQ ID NO: 110 - protein, 5 aa, Chlamydia trachomatis
EITQA

SEQ ID NO: 111 - protein, 5 aa, Chlamydia trachomatis
ITQAV

SEQ ID NO: 112 - protein, 5 aa, Chlamydia trachomatis
TQAVP

SEQ ID NO: 113 - protein, 5 aa, Chlamydia trachomatis
QAVPE

SEQ ID NO: 114 - protein, 5 aa, Chlamydia trachomatis
AVPEY

SEQ ID NO: 115 - protein, 5 aa, Chlamydia trachomatis
VPEYA

SEQ ID NO: 116 - protein, 5 aa, Chlamydia trachomatis
PEYAT

SEQ ID NO: 117 - protein, 5 aa, Chlamydia trachomatis
EYATV

SEQ ID NO: 118 - protein, 5 aa, Chlamydia trachomatis
YATVG

SEQ ID NO: 119 - protein, 5 aa, Chlamydia trachomatis
ATVGS

SEQ ID NO: 120 - protein, 5 aa, Chlamydia trachomatis
TVGSP

SEQ ID NO: 121 - protein, 5 aa, Chlamydia trachomatis
VGSPY

SEQ ID NO: 122 - protein, 5 aa, Chlamydia trachomatis
GSPYP

SEQ ID NO: 123 - protein, 5 aa, Chlamydia trachomatis
SPYPI

SEQ ID NO: 124 - protein, 5 aa, Chlamydia trachomatis
PYPIE

SEQ ID NO: 125 - protein, 5 aa, Chlamydia trachomatis
YPIEI

SEQ ID NO: 126 - protein, 5 aa, Chlamydia trachomatis
PIEIT

SEQ ID NO: 127 - protein, 5 aa, Chlamydia trachomatis
IEITA

SEQ ID NO: 128 - protein, 5 aa, Chlamydia trachomatis
EITAT

SEQ ID NO: 129 - protein, 5 aa, Chlamydia trachomatis
ITATG

SEQ ID NO: 130 - protein, 5 aa, Chlamydia trachomatis
TATGK

SEQ ID NO: 131 - protein, 5 aa, Chlamydia trachomatis
ATGKR

SEQ ID NO: 132 - protein, 5 aa, Chlamydia trachomatis
TGKRD

SEQ ID NO: 133 - protein, 5 aa, Chlamydia trachomatis
GKRDC

SEQ ID NO: 134 - protein, 5 aa, Chlamydia trachomatis
KRDCV

SEQ ID NO: 135 - protein, 5 aa, Chlamydia trachomatis
RDCVD

SEQ ID NO: 136 - protein, 5 aa, Chlamydia trachomatis
DCVDV

SEQ ID NO: 137 - protein, 5 aa, Chlamydia trachomatis
CVDVI

SEQ ID NO: 138 - protein, 5 aa, Chlamydia trachomatis
VDVII

SEQ ID NO: 139 - protein, 5 aa, Chlamydia trachomatis
DVIIT

SEQ ID NO: 140 - protein, 5 aa, Chlamydia trachomatis
VIITQ

SEQ ID NO: 141 - protein, 5 aa, Chlamydia trachomatis
IITQQ

SEQ ID NO: 142 - protein, 5 aa, Chlamydia trachomatis
ITQQL

SEQ ID NO: 143 - protein, 5 aa, Chlamydia trachomatis
TQQLP

SEQ ID NO: 144 - protein, 5 aa, Chlamydia trachomatis
QQLPC

SEQ ID NO: 145 - protein, 5 aa, Chlamydia trachomatis
QLPCE

SEQ ID NO: 146 - protein, 5 aa, Chlamydia trachomatis
LPCEA

SEQ ID NO: 147 - protein, 5 aa, Chlamydia trachomatis
PCEAE

SEQ ID NO: 148 - protein, 5 aa, Chlamydia trachomatis
CEAEF

SEQ ID NO: 149 - protein, 5 aa, Chlamydia trachomatis
EAEFV

SEQ ID NO: 150 - protein, 5 aa, Chlamydia trachomatis
AEFVR

SEQ ID NO: 151 - protein, 5 aa, Chlamydia trachomatis
EFVRS

SEQ ID NO: 152 - protein, 5 aa, Chlamydia trachomatis
FVRSD

SEQ ID NO: 153 - protein, 5 aa, Chlamydia trachomatis
VRSDP

SEQ ID NO: 154 - protein, 5 aa, Chlamydia trachomatis
RSDPA

SEQ ID NO: 155 - protein, 5 aa, Chlamydia trachomatis
SDPAT

SEQ ID NO: 156 - protein, 5 aa, Chlamydia trachomatis
DPATT

SEQ ID NO: 157 - protein, 5 aa, Chlamydia trachomatis
PATTP

SEQ ID NO: 158 - protein, 5 aa, Chlamydia trachomatis
ATTPT

SEQ ID NO: 159 - protein, 5 aa, Chlamydia trachomatis
TTPTA

SEQ ID NO: 160 - protein, 5 aa, Chlamydia trachomatis
TPTAD

SEQ ID NO: 161 - protein, 5 aa, Chlamydia trachomatis
PTADG

SEQ ID NO: 162 - protein, 5 aa, Chlamydia trachomatis
TADGK

SEQ ID NO: 163 - protein, 5 aa, Chlamydia trachomatis
ADGKL

SEQ ID NO: 164 - protein, 5 aa, Chlamydia trachomatis
DGKLV

SEQ ID NO: 165 - protein, 5 aa, Chlamydia trachomatis
GKLVW

SEQ ID NO: 166 - protein, 5 aa, Chlamydia trachomatis
KLVWK

SEQ ID NO: 167 - protein, 5 aa, Chlamydia trachomatis
LVWKI

SEQ ID NO: 168 - protein, 5 aa, Chlamydia trachomatis
VWKID

SEQ ID NO: 169 - protein, 5 aa, Chlamydia trachomatis
WKIDR

SEQ ID NO: 170 - protein, 5 aa, Chlamydia trachomatis
KIDRL

SEQ ID NO: 171 - protein, 5 aa, Chlamydia trachomatis
IDRLG

SEQ ID NO: 172 - protein, 5 aa, Chlamydia trachomatis
DRLGQ

SEQ ID NO: 173 - protein, 5 aa, Chlamydia trachomatis
RLGQG

SEQ ID NO: 174 - protein, 5 aa, Chlamydia trachomatis
LGQGE

SEQ ID NO: 175 - protein, 5 aa, Chlamydia trachomatis
GQGEK

SEQ ID NO: 176 - protein, 5 aa, Chlamydia trachomatis
QGEKS

SEQ ID NO: 177 - protein, 5 aa, Chlamydia trachomatis
GEKSK

SEQ ID NO: 178 - protein, 5 aa, Chlamydia trachomatis
EKSKI

SEQ ID NO: 179 - protein, 5 aa, Chlamydia trachomatis
KSKIT

SEQ ID NO: 180 - protein, 5 aa, Chlamydia trachomatis
SKITV

SEQ ID NO: 181 - protein, 5 aa, Chlamydia trachomatis
KITVW

SEQ ID NO: 182 - protein, 5 aa, Chlamydia trachomatis
ITVWV

SEQ ID NO: 183 - protein, 5 aa, Chlamydia trachomatis
TVWVK

SEQ ID NO: 184 - protein, 5 aa, Chlamydia trachomatis
VWVKP

SEQ ID NO: 185 - protein, 5 aa, Chlamydia trachomatis
WVKPL

SEQ ID NO: 186 - protein, 5 aa, Chlamydia trachomatis
VKPLK

SEQ ID NO: 187 - protein, 5 aa, Chlamydia trachomatis
KPLKE

SEQ ID NO: 188 - protein, 5 aa, Chlamydia trachomatis
PLKEG

SEQ ID NO: 189 - protein, 5 aa, Chlamydia trachomatis
LKEGC

SEQ ID NO: 190 - protein, 5 aa, Chlamydia trachomatis
KEGCC

SEQ ID NO: 191 - protein, 5 aa, Chlamydia trachomatis
EGCCF

SEQ ID NO: 192 - protein, 5 aa, Chlamydia trachomatis
GCCFT

SEQ ID NO: 193 - protein, 5 aa, Chlamydia trachomatis
CCFTA

SEQ ID NO: 194 - protein, 5 aa, Chlamydia trachomatis
CFTAA

SEQ ID NO: 195 - protein, 5 aa, Chlamydia trachomatis
FTAAT

SEQ ID NO: 196 - protein, 5 aa, Chlamydia trachomatis
TAATV

SEQ ID NO: 197 - protein, 5 aa, Chlamydia trachomatis
AATVC

SEQ ID NO: 198 - protein, 5 aa, Chlamydia trachomatis
ATVCA

SEQ ID NO: 199 - protein, 5 aa, Chlamydia trachomatis
TVCAC

SEQ ID NO: 200 - protein, 5 aa, Chlamydia trachomatis
VCACP

SEQ ID NO: 201 - protein, 5 aa, Chlamydia trachomatis
CACPE

SEQ ID NO: 202 - protein, 5 aa, Chlamydia trachomatis
ACPEI

SEQ ID NO: 203 - protein, 5 aa, Chlamydia trachomatis
CPEIR

SEQ ID NO: 204 - protein, 5 aa, Chlamydia trachomatis
PEIRS

SEQ ID NO: 205 - protein, 5 aa, Chlamydia trachomatis
EIRSV

SEQ ID NO: 206 - protein, 5 aa, Chlamydia trachomatis
IRSVT

SEQ ID NO: 207 - protein, 5 aa, Chlamydia trachomatis
RSVTK

SEQ ID NO: 208 - protein, 5 aa, Chlamydia trachomatis
SVTKC

SEQ ID NO: 209 - protein, 5 aa, Chlamydia trachomatis
VTKCG

SEQ ID NO: 210 - protein, 5 aa, Chlamydia trachomatis
TKCGQ

SEQ ID NO: 211 - protein, 5 aa, Chlamydia trachomatis
KCGQP

SEQ ID NO: 212 - protein, 5 aa, Chlamydia trachomatis
CGQPA

SEQ ID NO: 213 - protein, 5 aa, Chlamydia trachomatis
GQPAI

SEQ ID NO: 214 - protein, 5 aa, Chlamydia trachomatis
QPAIC

SEQ ID NO: 215 - protein, 5 aa, Chlamydia trachomatis
PAICV

SEQ ID NO: 216 - protein, 5 aa, Chlamydia trachomatis
AICVK

SEQ ID NO: 217 - protein, 5 aa, Chlamydia trachomatis
ICVKQ

SEQ ID NO: 218 - protein, 5 aa, Chlamydia trachomatis
CVKQE

SEQ ID NO: 219 - protein, 5 aa, Chlamydia trachomatis
VKQEG

SEQ ID NO: 220 - protein, 5 aa, Chlamydia trachomatis
KQEGP

SEQ ID NO: 221 - protein, 5 aa, Chlamydia trachomatis
QEGPE

SEQ ID NO: 222 - protein, 5 aa, Chlamydia trachomatis
EGPEN

SEQ ID NO: 223 - protein, 5 aa, Chlamydia trachomatis
GPENA

SEQ ID NO: 224 - protein, 5 aa, Chlamydia trachomatis
PENAC

SEQ ID NO: 225 - protein, 5 aa, Chlamydia trachomatis
ENACL

SEQ ID NO: 226 - protein, 5 aa, Chlamydia trachomatis
NACLR

SEQ ID NO: 227 - protein, 5 aa, Chlamydia trachomatis
ACLRC

SEQ ID NO: 228 - protein, 5 aa, Chlamydia trachomatis
CLRCP

SEQ ID NO: 229 - protein, 5 aa, Chlamydia trachomatis
LRCPV

SEQ ID NO: 230 - protein, 5 aa, Chlamydia trachomatis
RCPVV

SEQ ID NO: 231 - protein, 5 aa, Chlamydia trachomatis
CPVVY

SEQ ID NO: 232 - protein, 5 aa, Chlamydia trachomatis
PVVYK

SEQ ID NO: 233 - protein, 5 aa, Chlamydia trachomatis
VVYKI

SEQ ID NO: 234 - protein, 5 aa, Chlamydia trachomatis
VYKIN

SEQ ID NO: 235 - protein, 5 aa, Chlamydia trachomatis
YKINI

SEQ ID NO: 236 - protein, 5 aa, Chlamydia trachomatis
KINIV

SEQ ID NO: 237 - protein, 5 aa, Chlamydia trachomatis
INIVN

SEQ ID NO: 238 - protein, 5 aa, Chlamydia trachomatis
NIVNQ

SEQ ID NO: 239 - protein, 5 aa, Chlamydia trachomatis
IVNQG

SEQ ID NO: 240 - protein, 5 aa, Chlamydia trachomatis
VNQGT

SEQ ID NO: 241 - protein, 5 aa, Chlamydia trachomatis
NQGTA

SEQ ID NO: 242 - protein, 5 aa, Chlamydia trachomatis
QGTAT

SEQ ID NO: 243 - protein, 5 aa, Chlamydia trachomatis
GTATA

SEQ ID NO: 244 - protein, 5 aa, Chlamydia trachomatis
TATAR

SEQ ID NO: 245 - protein, 5 aa, Chlamydia trachomatis
ATARN

SEQ ID NO: 246 - protein, 5 aa, Chlamydia trachomatis
TARNV

SEQ ID NO: 247 - protein, 5 aa, Chlamydia trachomatis
ARNVV

SEQ ID NO: 248 - protein, 5 aa, Chlamydia trachomatis
RNVVV

SEQ ID NO: 249 - protein, 5 aa, Chlamydia trachomatis
NVVVE

SEQ ID NO: 250 - protein, 5 aa, Chlamydia trachomatis
VVVEN

SEQ ID NO: 251 - protein, 5 aa, Chlamydia trachomatis
VVENP

SEQ ID NO: 252 - protein, 5 aa, Chlamydia trachomatis
VENPV

SEQ ID NO: 253 - protein, 5 aa, Chlamydia trachomatis
ENPVP

SEQ ID NO: 254 - protein, 5 aa, Chlamydia trachomatis
NPVPD

SEQ ID NO: 255 - protein, 5 aa, Chlamydia trachomatis
PVPDG

SEQ ID NO: 256 - protein, 5 aa, Chlamydia trachomatis
VPDGY

SEQ ID NO: 257 - protein, 5 aa, Chlamydia trachomatis
PDGYA

SEQ ID NO: 258 - protein, 5 aa, Chlamydia trachomatis
DGYAH

SEQ ID NO: 259 - protein, 5 aa, Chlamydia trachomatis
GYAHS

SEQ ID NO: 260 - protein, 5 aa, Chlamydia trachomatis
YAHSS

SEQ ID NO: 261 - protein, 5 aa, Chlamydia trachomatis
AHSSG

SEQ ID NO: 262 - protein, 5 aa, Chlamydia trachomatis
HSSGQ

SEQ ID NO: 263 - protein, 5 aa, Chlamydia trachomatis
SSGQR

SEQ ID NO: 264 - protein, 5 aa, Chlamydia trachomatis
SGQRV

SEQ ID NO: 265 - protein, 5 aa, Chlamydia trachomatis
GQRVL

SEQ ID NO: 266 - protein, 5 aa, Chlamydia trachomatis
QRVLT

SEQ ID NO: 267 - protein, 5 aa, Chlamydia trachomatis
RVLTF

SEQ ID NO: 268 - protein, 5 aa, Chlamydia trachomatis
VLTFT

SEQ ID NO: 269 - protein, 5 aa, Chlamydia trachomatis
LTFTL

SEQ ID NO: 270 - protein, 5 aa, Chlamydia trachomatis
TFTLG

SEQ ID NO: 271 - protein, 5 aa, Chlamydia trachomatis
FTLGD

SEQ ID NO: 272 - protein, 5 aa, Chlamydia trachomatis
TLGDM

SEQ ID NO: 273 - protein, 5 aa, Chlamydia trachomatis
LGDMQ

SEQ ID NO: 274 - protein, 5 aa, Chlamydia trachomatis
GDMQP

SEQ ID NO: 275 - protein, 5 aa, Chlamydia trachomatis
DMQPG

SEQ ID NO: 276 - protein, 5 aa, Chlamydia trachomatis
MQPGE

SEQ ID NO: 277 - protein, 5 aa, Chlamydia trachomatis
QPGEH

SEQ ID NO: 278 - protein, 5 aa, Chlamydia trachomatis
PGEHR

SEQ ID NO: 279 - protein, 5 aa, Chlamydia trachomatis
GEHRT

SEQ ID NO: 280 - protein, 5 aa, Chlamydia trachomatis
EHRTI

SEQ ID NO: 281 - protein, 5 aa, Chlamydia trachomatis
HRTIT

SEQ ID NO: 282 - protein, 5 aa, Chlamydia trachomatis
RTITV

SEQ ID NO: 283 - protein, 5 aa, Chlamydia trachomatis
TITVE

SEQ ID NO: 284 - protein, 5 aa, Chlamydia trachomatis
ITVEF

SEQ ID NO: 285 - protein, 5 aa, Chlamydia trachomatis
TVEFC

SEQ ID NO: 286 - protein, 5 aa, Chlamydia trachomatis
VEFCP

SEQ ID NO: 287 - protein, 5 aa, Chlamydia trachomatis
EFCPL

SEQ ID NO: 288 - protein, 5 aa, Chlamydia trachomatis
FCPLK

SEQ ID NO: 289 - protein, 5 aa, Chlamydia trachomatis
CPLKR

SEQ ID NO: 290 - protein, 5 aa, Chlamydia trachomatis
PLKRG

SEQ ID NO: 291 - protein, 5 aa, Chlamydia trachomatis
LKRGR

SEQ ID NO: 292 - protein, 5 aa, Chlamydia trachomatis
KRGRA

SEQ ID NO: 293 - protein, 5 aa, Chlamydia trachomatis
RGRAT

SEQ ID NO: 294 - protein, 5 aa, Chlamydia trachomatis
GRATN

SEQ ID NO: 295 - protein, 5 aa, Chlamydia trachomatis
RATNI

SEQ ID NO: 296 - protein, 5 aa, Chlamydia trachomatis
ATNIA

SEQ ID NO: 297 - protein, 5 aa, Chlamydia trachomatis
TNIAT

SEQ ID NO: 298 - protein, 5 aa, Chlamydia trachomatis
NIATV

SEQ ID NO: 299 - protein, 5 aa, Chlamydia trachomatis
IATVS

SEQ ID NO: 300 - protein, 5 aa, Chlamydia trachomatis
ATVSY

SEQ ID NO: 301 - protein, 5 aa, Chlamydia trachomatis
TVSYC

SEQ ID NO: 302 - protein, 5 aa, Chlamydia trachomatis
VSYCG

SEQ ID NO: 303 - protein, 5 aa, Chlamydia trachomatis
SYCGG

SEQ ID NO: 304 - protein, 5 aa, Chlamydia trachomatis
YCGGH

SEQ ID NO: 305 - protein, 5 aa, Chlamydia trachomatis
CGGHK

SEQ ID NO: 306 - protein, 5 aa, Chlamydia trachomatis
GGHKN

SEQ ID NO: 307 - protein, 5 aa, Chlamydia trachomatis
GHKNT

SEQ ID NO: 308 - protein, 5 aa, Chlamydia trachomatis
HKNTA

SEQ ID NO: 309 - protein, 5 aa, Chlamydia trachomatis
KNTAS

SEQ ID NO: 310 - protein, 5 aa, Chlamydia trachomatis
NTASV

SEQ ID NO: 311 - protein, 5 aa, Chlamydia trachomatis
TASVT

SEQ ID NO: 312 - protein, 5 aa, Chlamydia trachomatis
ASVTT

SEQ ID NO: 313 - protein, 5 aa, Chlamydia trachomatis
SVTTV

SEQ ID NO: 314 - protein, 5 aa, Chlamydia trachomatis
VTTVI

SEQ ID NO: 315 - protein, 5 aa, Chlamydia trachomatis
TTVIN

SEQ ID NO: 316 - protein, 5 aa, Chlamydia trachomatis
TVINE

SEQ ID NO: 317 - protein, 5 aa, Chlamydia trachomatis
VINEP

SEQ ID NO: 318 - protein, 5 aa, Chlamydia trachomatis
INEPC

SEQ ID NO: 319 - protein, 5 aa, Chlamydia trachomatis
NEPCV

SEQ ID NO: 320 - protein, 5 aa, Chlamydia trachomatis
EPCVQ

SEQ ID NO: 321 - protein, 5 aa, Chlamydia trachomatis
PCVQV

SEQ ID NO: 322 - protein, 5 aa, Chlamydia trachomatis
CVQVS

SEQ ID NO: 323 - protein, 5 aa, Chlamydia trachomatis
VQVSI

SEQ ID NO: 324 - protein, 5 aa, Chlamydia trachomatis
QVSIA

SEQ ID NO: 325 - protein, 5 aa, Chlamydia trachomatis
VSIAG

SEQ ID NO: 326 - protein, 5 aa, Chlamydia trachomatis
SIAGA

SEQ ID NO: 327 - protein, 5 aa, Chlamydia trachomatis
IAGAD

SEQ ID NO: 328 - protein, 5 aa, Chlamydia trachomatis
AGADW

SEQ ID NO: 329 - protein, 5 aa, Chlamydia trachomatis
GADWS

SEQ ID NO: 330 - protein, 5 aa, Chlamydia trachomatis
ADWSY

SEQ ID NO: 331 - protein, 5 aa, Chlamydia trachomatis
DWSYV

SEQ ID NO: 332 - protein, 5 aa, Chlamydia trachomatis
WSYVC

SEQ ID NO: 333 - protein, 5 aa, Chlamydia trachomatis
SYVCK

SEQ ID NO: 334 - protein, 5 aa, Chlamydia trachomatis
YVCKP

SEQ ID NO: 335 - protein, 5 aa, Chlamydia trachomatis
VCKPV

SEQ ID NO: 336 - protein, 5 aa, Chlamydia trachomatis
CKPVE

SEQ ID NO: 337 - protein, 5 aa, Chlamydia trachomatis
KPVEY

SEQ ID NO: 338 - protein, 5 aa, Chlamydia trachomatis
PVEYV

SEQ ID NO: 339 - protein, 5 aa, Chlamydia trachomatis
VEYVI

SEQ ID NO: 340 - protein, 5 aa, Chlamydia trachomatis
EYVIS

SEQ ID NO: 341 - protein, 5 aa, Chlamydia trachomatis
YVISV

SEQ ID NO: 342 - protein, 5 aa, Chlamydia trachomatis
VISVS

SEQ ID NO: 343 - protein, 5 aa, Chlamydia trachomatis
ISVSN

SEQ ID NO: 344 - protein, 5 aa, Chlamydia trachomatis
SVSNP

SEQ ID NO: 345 - protein, 5 aa, Chlamydia trachomatis
VSNPG

SEQ ID NO: 346 - protein, 5 aa, Chlamydia trachomatis
SNPGD

SEQ ID NO: 347 - protein, 5 aa, Chlamydia trachomatis
NPGDL

SEQ ID NO: 348 - protein, 5 aa, Chlamydia trachomatis
PGDLV

SEQ ID NO: 349 - protein, 5 aa, Chlamydia trachomatis
GDLVL

SEQ ID NO: 350 - protein, 5 aa, Chlamydia trachomatis
DLVLR

SEQ ID NO: 351 - protein, 5 aa, Chlamydia trachomatis
LVLRD

SEQ ID NO: 352 - protein, 5 aa, Chlamydia trachomatis
VLRDV

SEQ ID NO: 353 - protein, 5 aa, Chlamydia trachomatis
LRDVV

SEQ ID NO: 354 - protein, 5 aa, Chlamydia trachomatis
RDVVV

SEQ ID NO: 355 - protein, 5 aa, Chlamydia trachomatis
DVVVE

SEQ ID NO: 356 - protein, 5 aa, Chlamydia trachomatis
VVVED

SEQ ID NO: 357 - protein, 5 aa, Chlamydia trachomatis
VVEDT

SEQ ID NO: 358 - protein, 5 aa, Chlamydia trachomatis
VEDTL

SEQ ID NO: 359 - protein, 5 aa, Chlamydia trachomatis
EDTLS

SEQ ID NO: 360 - protein, 5 aa, Chlamydia trachomatis
DTLSP

SEQ ID NO: 361 - protein, 5 aa, Chlamydia trachomatis
TLSPG

SEQ ID NO: 362 - protein, 5 aa, Chlamydia trachomatis
LSPGV

SEQ ID NO: 363 - protein, 5 aa, Chlamydia trachomatis
SPGVT

SEQ ID NO: 364 - protein, 5 aa, Chlamydia trachomatis
PGVTV

SEQ ID NO: 365 - protein, 5 aa, Chlamydia trachomatis
GVTVL

SEQ ID NO: 366 - protein, 5 aa, Chlamydia trachomatis
VTVLE

SEQ ID NO: 367 - protein, 5 aa, Chlamydia trachomatis
TVLEA

SEQ ID NO: 368 - protein, 5 aa, Chlamydia trachomatis
VLEAA

SEQ ID NO: 369 - protein, 5 aa, Chlamydia trachomatis
LEAAG

SEQ ID NO: 370 - protein, 5 aa, Chlamydia trachomatis
EAAGA

SEQ ID NO: 371 - protein, 5 aa, Chlamydia trachomatis
AAGAQ

SEQ ID NO: 372 - protein, 5 aa, Chlamydia trachomatis
AGAQI

SEQ ID NO: 373 - protein, 5 aa, Chlamydia trachomatis
GAQIS

SEQ ID NO: 374 - protein, 5 aa, Chlamydia trachomatis
AQISC

SEQ ID NO: 375 - protein, 5 aa, Chlamydia trachomatis
QISCN

SEQ ID NO: 376 - protein, 5 aa, Chlamydia trachomatis
ISCNK

SEQ ID NO: 377 - protein, 5 aa, Chlamydia trachomatis
SCNKV

SEQ ID NO: 378 - protein, 5 aa, Chlamydia trachomatis
CNKVV

SEQ ID NO: 379 - protein, 5 aa, Chlamydia trachomatis
NKVVW

SEQ ID NO: 380 - protein, 5 aa, Chlamydia trachomatis
KVVWT

SEQ ID NO: 381 - protein, 5 aa, Chlamydia trachomatis
VVWTV

SEQ ID NO: 382 - protein, 5 aa, Chlamydia trachomatis
VWTVK

SEQ ID NO: 383 - protein, 5 aa, Chlamydia trachomatis
WTVKE

SEQ ID NO: 384 - protein, 5 aa, Chlamydia trachomatis
TVKEL

SEQ ID NO: 385 - protein, 5 aa, Chlamydia trachomatis
VKELN

SEQ ID NO: 386 - protein, 5 aa, Chlamydia trachomatis
KELNP

SEQ ID NO: 387 - protein, 5 aa, Chlamydia trachomatis
ELNPG

SEQ ID NO: 388 - protein, 5 aa, Chlamydia trachomatis
LNPGE

SEQ ID NO: 389 - protein, 5 aa, Chlamydia trachomatis
NPGES

SEQ ID NO: 390 - protein, 5 aa, Chlamydia trachomatis
PGESL

SEQ ID NO: 391 - protein, 5 aa, Chlamydia trachomatis
GESLQ

SEQ ID NO: 392 - protein, 5 aa, Chlamydia trachomatis
ESLQY

SEQ ID NO: 393 - protein, 5 aa, Chlamydia trachomatis
SLQYK

SEQ ID NO: 394 - protein, 5 aa, Chlamydia trachomatis
LQYKV

SEQ ID NO: 395 - protein, 5 aa, Chlamydia trachomatis
QYKVL

SEQ ID NO: 396 - protein, 5 aa, Chlamydia trachomatis
YKVLV

SEQ ID NO: 397 - protein, 5 aa, Chlamydia trachomatis
KVLVR

SEQ ID NO: 398 - protein, 5 aa, Chlamydia trachomatis
VLVRA

SEQ ID NO: 399 - protein, 5 aa, Chlamydia trachomatis
LVRAQ

SEQ ID NO: 400 - protein, 5 aa, Chlamydia trachomatis
VRAQT

SEQ ID NO: 401 - protein, 5 aa, Chlamydia trachomatis
RAQTP

SEQ ID NO: 402 - protein, 5 aa, Chlamydia trachomatis
AQTPG

SEQ ID NO: 403 - protein, 5 aa, Chlamydia trachomatis
QTPGQ

SEQ ID NO: 404 - protein, 5 aa, Chlamydia trachomatis
TPGQF

SEQ ID NO: 405 - protein, 5 aa, Chlamydia trachomatis
PGQFT

SEQ ID NO: 406 - protein, 5 aa, Chlamydia trachomatis
GQFTN

SEQ ID NO: 407 - protein, 5 aa, Chlamydia trachomatis
QFTNN

SEQ ID NO: 408 - protein, 5 aa, Chlamydia trachomatis
FTNNV

SEQ ID NO: 409 - protein, 5 aa, Chlamydia trachomatis
TNNVV

SEQ ID NO: 410 - protein, 5 aa, Chlamydia trachomatis
NNVVV

SEQ ID NO: 411 - protein, 5 aa, Chlamydia trachomatis
NVVVK

SEQ ID NO: 412 - protein, 5 aa, Chlamydia trachomatis
VVVKS

SEQ ID NO: 413 - protein, 5 aa, Chlamydia trachomatis
VVKSC

SEQ ID NO: 414 - protein, 5 aa, Chlamydia trachomatis
VKSCS

SEQ ID NO: 415 - protein, 5 aa, Chlamydia trachomatis
KSCSD

SEQ ID NO: 416 - protein, 5 aa, Chlamydia trachomatis
SCSDC

SEQ ID NO: 417 - protein, 5 aa, Chlamydia trachomatis
CSDCG

SEQ ID NO: 418 - protein, 5 aa, Chlamydia trachomatis
SDCGT

SEQ ID NO: 419 - protein, 5 aa, Chlamydia trachomatis
DCGTC

SEQ ID NO: 420 - protein, 5 aa, Chlamydia trachomatis
CGTCT

SEQ ID NO: 421 - protein, 5 aa, Chlamydia trachomatis
GTCTS

SEQ ID NO: 422 - protein, 5 aa, Chlamydia trachomatis
TCTSC

SEQ ID NO: 423 - protein, 5 aa, Chlamydia trachomatis
CTSCA

SEQ ID NO: 424 - protein, 5 aa, Chlamydia trachomatis
TSCAE

SEQ ID NO: 425 - protein, 5 aa, Chlamydia trachomatis
SCAEA

SEQ ID NO: 426 - protein, 5 aa, Chlamydia trachomatis
CAEAT

SEQ ID NO: 427 - protein, 5 aa, Chlamydia trachomatis
AEATT

SEQ ID NO: 428 - protein, 5 aa, Chlamydia trachomatis
EATTY

SEQ ID NO: 429 - protein, 5 aa, Chlamydia trachomatis
ATTYW

SEQ ID NO: 430 - protein, 5 aa, Chlamydia trachomatis
TTYWK

SEQ ID NO: 431 - protein, 5 aa, Chlamydia trachomatis
TYWKG

SEQ ID NO: 432 - protein, 5 aa, Chlamydia trachomatis
YWKGV

SEQ ID NO: 433 - protein, 5 aa, Chlamydia trachomatis
WKGVA

SEQ ID NO: 434 - protein, 5 aa, Chlamydia trachomatis
KGVAA

SEQ ID NO: 435 - protein, 5 aa, Chlamydia trachomatis
GVAAT

SEQ ID NO: 436 - protein, 5 aa, Chlamydia trachomatis
VAATH

SEQ ID NO: 437 - protein, 5 aa, Chlamydia trachomatis
AATHM

SEQ ID NO: 438 - protein, 5 aa, Chlamydia trachomatis
ATHMC

SEQ ID NO: 439 - protein, 5 aa, Chlamydia trachomatis
THMCV

SEQ ID NO: 440 - protein, 5 aa, Chlamydia trachomatis
HMCVV

SEQ ID NO: 441 - protein, 5 aa, Chlamydia trachomatis
MCVVD

SEQ ID NO: 442 - protein, 5 aa, Chlamydia trachomatis
CVVDT

SEQ ID NO: 443 - protein, 5 aa, Chlamydia trachomatis
VVDTC

SEQ ID NO: 444 - protein, 5 aa, Chlamydia trachomatis
VDTCD

SEQ ID NO: 445 - protein, 5 aa, Chlamydia trachomatis
DTCDP

SEQ ID NO: 446 - protein, 5 aa, Chlamydia trachomatis
TCDPV

SEQ ID NO: 447 - protein, 5 aa, Chlamydia trachomatis
CDPVC

SEQ ID NO: 448 - protein, 5 aa, Chlamydia trachomatis
DPVCV

SEQ ID NO: 449 - protein, 5 aa, Chlamydia trachomatis
PVCVG

SEQ ID NO: 450 - protein, 5 aa, Chlamydia trachomatis
VCVGE

SEQ ID NO: 451 - protein, 5 aa, Chlamydia trachomatis
CVGEN

SEQ ID NO: 452 - protein, 5 aa, Chlamydia trachomatis
VGENT

SEQ ID NO: 453 - protein, 5 aa, Chlamydia trachomatis
GENTV

SEQ ID NO: 454 - protein, 5 aa, Chlamydia trachomatis
ENTVY

SEQ ID NO: 455 - protein, 5 aa, Chlamydia trachomatis
NTVYR

SEQ ID NO: 456 - protein, 5 aa, Chlamydia trachomatis
TVYRI

SEQ ID NO: 457 - protein, 5 aa, Chlamydia trachomatis
VYRIC

SEQ ID NO: 458 - protein, 5 aa, Chlamydia trachomatis
YRICV

SEQ ID NO: 459 - protein, 5 aa, Chlamydia trachomatis
RICVT

SEQ ID NO: 460 - protein, 5 aa, Chlamydia trachomatis
ICVTN

SEQ ID NO: 461 - protein, 5 aa, Chlamydia trachomatis
CVTNR

SEQ ID NO: 462 - protein, 5 aa, Chlamydia trachomatis
VTNRG

SEQ ID NO: 463 - protein, 5 aa, Chlamydia trachomatis
TNRGS

SEQ ID NO: 464 - protein, 5 aa, Chlamydia trachomatis
NRGSA

SEQ ID NO: 465 - protein, 5 aa, Chlamydia trachomatis
RGSAE

SEQ ID NO: 466 - protein, 5 aa, Chlamydia trachomatis
GSAED

SEQ ID NO: 467 - protein, 5 aa, Chlamydia trachomatis
SAEDT

SEQ ID NO: 468 - protein, 5 aa, Chlamydia trachomatis
AEDTN

SEQ ID NO: 469 - protein, 5 aa, Chlamydia trachomatis
EDTNV

SEQ ID NO: 470 - protein, 5 aa, Chlamydia trachomatis
DTNVS

SEQ ID NO: 471 - protein, 5 aa, Chlamydia trachomatis
TNVSL

SEQ ID NO: 472 - protein, 5 aa, Chlamydia trachomatis
NVSLM

SEQ ID NO: 473 - protein, 5 aa, Chlamydia trachomatis
VSLML

SEQ ID NO: 474 - protein, 5 aa, Chlamydia trachomatis
SLMLK

SEQ ID NO: 475 - protein, 5 aa, Chlamydia trachomatis
LMLKF

SEQ ID NO: 476 - protein, 5 aa, Chlamydia trachomatis
MLKFS

SEQ ID NO: 477 - protein, 5 aa, Chlamydia trachomatis
LKFSK

SEQ ID NO: 478 - protein, 5 aa, Chlamydia trachomatis
KFSKE

SEQ ID NO: 479 - protein, 5 aa, Chlamydia trachomatis
FSKEL

SEQ ID NO: 480 - protein, 5 aa, Chlamydia trachomatis
SKELQ

SEQ ID NO: 481 - protein, 5 aa, Chlamydia trachomatis
KELQP

SEQ ID NO: 482 - protein, 5 aa, Chlamydia trachomatis
ELQPV

SEQ ID NO: 483 - protein, 5 aa, Chlamydia trachomatis
LQPVS

SEQ ID NO: 484 - protein, 5 aa, Chlamydia trachomatis
QPVSF

SEQ ID NO: 485 - protein, 5 aa, Chlamydia trachomatis
PVSFS

SEQ ID NO: 486 - protein, 5 aa, Chlamydia trachomatis
VSFSG

SEQ ID NO: 487 - protein, 5 aa, Chlamydia trachomatis
SFSGP

SEQ ID NO: 488 - protein, 5 aa, Chlamydia trachomatis
FSGPT

SEQ ID NO: 489 - protein, 5 aa, Chlamydia trachomatis
SGPTK

SEQ ID NO: 490 - protein, 5 aa, Chlamydia trachomatis
GPTKG

SEQ ID NO: 491 - protein, 5 aa, Chlamydia trachomatis
PTKGT

SEQ ID NO: 492 - protein, 5 aa, Chlamydia trachomatis
TKGTI

SEQ ID NO: 493 - protein, 5 aa, Chlamydia trachomatis
KGTIT

SEQ ID NO: 494 - protein, 5 aa, Chlamydia trachomatis
GTITG

SEQ ID NO: 495 - protein, 5 aa, Chlamydia trachomatis
TITGN

SEQ ID NO: 496 - protein, 5 aa, Chlamydia trachomatis
ITGNT

SEQ ID NO: 497 - protein, 5 aa, Chlamydia trachomatis
TGNTV

SEQ ID NO: 498 - protein, 5 aa, Chlamydia trachomatis
GNTVV

SEQ ID NO: 499 - protein, 5 aa, Chlamydia trachomatis
NTVVF

SEQ ID NO: 500 - protein, 5 aa, Chlamydia trachomatis
TVVFD

SEQ ID NO: 501 - protein, 5 aa, Chlamydia trachomatis
VVFDS

SEQ ID NO: 502 - protein, 5 aa, Chlamydia trachomatis
VFDSL

SEQ ID NO: 503 - protein, 5 aa, Chlamydia trachomatis
FDSLP

SEQ ID NO: 504 - protein, 5 aa, Chlamydia trachomatis
DSLPR

SEQ ID NO: 505 - protein, 5 aa, Chlamydia trachomatis
SLPRL

SEQ ID NO: 506 - protein, 5 aa, Chlamydia trachomatis
LPRLG

SEQ ID NO: 507 - protein, 5 aa, Chlamydia trachomatis
PRLGS

SEQ ID NO: 508 - protein, 5 aa, Chlamydia trachomatis
RLGSK

SEQ ID NO: 509 - protein, 5 aa, Chlamydia trachomatis
LGSKE

SEQ ID NO: 510 - protein, 5 aa, Chlamydia trachomatis
GSKET

SEQ ID NO: 511 - protein, 5 aa, Chlamydia trachomatis
SKETV

SEQ ID NO: 512 - protein, 5 aa, Chlamydia trachomatis
KETVE

SEQ ID NO: 513 - protein, 5 aa, Chlamydia trachomatis
ETVEF

SEQ ID NO: 514 - protein, 5 aa, Chlamydia trachomatis
TVEFS

SEQ ID NO: 515 - protein, 5 aa, Chlamydia trachomatis
VEFSV

SEQ ID NO: 516 - protein, 5 aa, Chlamydia trachomatis
EFSVT

SEQ ID NO: 517 - protein, 5 aa, Chlamydia trachomatis
FSVTL

SEQ ID NO: 518 - protein, 5 aa, Chlamydia trachomatis
SVTLK

SEQ ID NO: 519 - protein, 5 aa, Chlamydia trachomatis
VTLKA

SEQ ID NO: 520 - protein, 5 aa, Chlamydia trachomatis
TLKAV

SEQ ID NO: 521 - protein, 5 aa, Chlamydia trachomatis
LKAVS

SEQ ID NO: 522 - protein, 5 aa, Chlamydia trachomatis
KAVSA

SEQ ID NO: 523 - protein, 5 aa, Chlamydia trachomatis
AVSAG

SEQ ID NO: 524 - protein, 5 aa, Chlamydia trachomatis
VSAGD

SEQ ID NO: 525 - protein, 5 aa, Chlamydia trachomatis
SAGDA

SEQ ID NO: 526 - protein, 5 aa, Chlamydia trachomatis
AGDAR

SEQ ID NO: 527 - protein, 5 aa, Chlamydia trachomatis
GDARG

SEQ ID NO: 528 - protein, 5 aa, Chlamydia trachomatis
DARGE

SEQ ID NO: 529 - protein, 5 aa, Chlamydia trachomatis
ARGEA

SEQ ID NO: 530 - protein, 5 aa, Chlamydia trachomatis
RGEAI

SEQ ID NO: 531 - protein, 5 aa, Chlamydia trachomatis
GEAIL

SEQ ID NO: 532 - protein, 5 aa, Chlamydia trachomatis
EAILS

SEQ ID NO: 533 - protein, 5 aa, Chlamydia trachomatis
AILSS

SEQ ID NO: 534 - protein, 5 aa, Chlamydia trachomatis
ILSSD

SEQ ID NO: 535 - protein, 5 aa, Chlamydia trachomatis
LSSDT

SEQ ID NO: 536 - protein, 5 aa, Chlamydia trachomatis
SSDTL

SEQ ID NO: 537 - protein, 5 aa, Chlamydia trachomatis
SDTLT

SEQ ID NO: 538 - protein, 5 aa, Chlamydia trachomatis
DTLTV

SEQ ID NO: 539 - protein, 5 aa, Chlamydia trachomatis
TLTVP

SEQ ID NO: 540 - protein, 5 aa, Chlamydia trachomatis
LTVPV

SEQ ID NO: 541 - protein, 5 aa, Chlamydia trachomatis
TVPVS

SEQ ID NO: 542 - protein, 5 aa, Chlamydia trachomatis
VPVSD

SEQ ID NO: 543 - protein, 5 aa, Chlamydia trachomatis
PVSDT

SEQ ID NO: 544 - protein, 5 aa, Chlamydia trachomatis
VSDTE

SEQ ID NO: 545 - protein, 5 aa, Chlamydia trachomatis
SDTEN

SEQ ID NO: 546 - protein, 5 aa, Chlamydia trachomatis
DTENT

SEQ ID NO: 547 - protein, 5 aa, Chlamydia trachomatis
TENTH

SEQ ID NO: 548 - protein, 5 aa, Chlamydia trachomatis
ENTHI

SEQ ID NO: 549 - protein, 5 aa, Chlamydia trachomatis
NTHIY

SEQ ID NO: 550 - protein, 5 aa, Chlamydia trachomatis
MCIKR

SEQ ID NO: 551 - protein, 5 aa, Chlamydia trachomatis
CIKRK

SEQ ID NO: 552 - protein, 5 aa, Chlamydia trachomatis
IKRKK

SEQ ID NO: 553 - protein, 5 aa, Chlamydia trachomatis
KRKKT

SEQ ID NO: 554 - protein, 5 aa, Chlamydia trachomatis
RKKTW

SEQ ID NO: 555 - protein, 5 aa, Chlamydia trachomatis
KKTWI

SEQ ID NO: 556 - protein, 5 aa, Chlamydia trachomatis
KTWIA

SEQ ID NO: 557 - protein, 5 aa, Chlamydia trachomatis
TWIAF

SEQ ID NO: 558 - protein, 5 aa, Chlamydia trachomatis
WIAFL

SEQ ID NO: 559 - protein, 5 aa, Chlamydia trachomatis
IAFLA

SEQ ID NO: 560 - protein, 5 aa, Chlamydia trachomatis
AFLAV

SEQ ID NO: 561 - protein, 5 aa, Chlamydia trachomatis
FLAVV

SEQ ID NO: 562 - protein, 5 aa, Chlamydia trachomatis
LAVVC

SEQ ID NO: 563 - protein, 5 aa, Chlamydia trachomatis
AVVCS

SEQ ID NO: 564 - protein, 5 aa, Chlamydia trachomatis
VVCSF

SEQ ID NO: 565 - protein, 5 aa, Chlamydia trachomatis
VCSFC

SEQ ID NO: 566 - protein, 5 aa, Chlamydia trachomatis
CSFCL

SEQ ID NO: 567 - protein, 5 aa, Chlamydia trachomatis
SFCLT

SEQ ID NO: 568 - protein, 5 aa, Chlamydia trachomatis
FCLTG

SEQ ID NO: 569 - protein, 5 aa, Chlamydia trachomatis
CLTGC

SEQ ID NO: 570 - protein, 5 aa, Chlamydia trachomatis
LTGCL

SEQ ID NO: 571 - protein, 5 aa, Chlamydia trachomatis
TGCLK

SEQ ID NO: 572 - protein, 5 aa, Chlamydia trachomatis
GCLKE

SEQ ID NO: 573 - protein, 5 aa, Chlamydia trachomatis
CLKEG

SEQ ID NO: 574 - protein, 5 aa, Chlamydia trachomatis
LKEGG

SEQ ID NO: 575 - protein, 5 aa, Chlamydia trachomatis
KEGGD

SEQ ID NO: 576 - protein, 5 aa, Chlamydia trachomatis
EGGDS

SEQ ID NO: 577 - protein, 5 aa, Chlamydia trachomatis
GGDSN

SEQ ID NO: 578 - protein, 5 aa, Chlamydia trachomatis
GDSNS

SEQ ID NO: 579 - protein, 5 aa, Chlamydia trachomatis
DSNSE

SEQ ID NO: 580 - protein, 5 aa, Chlamydia trachomatis
SNSEK

SEQ ID NO: 581 - protein, 5 aa, Chlamydia trachomatis
NSEKF

SEQ ID NO: 582 - protein, 5 aa, Chlamydia trachomatis
SEKFI

SEQ ID NO: 583 - protein, 5 aa, Chlamydia trachomatis
EKFIV

SEQ ID NO: 584 - protein, 5 aa, Chlamydia trachomatis
KFIVG

SEQ ID NO: 585 - protein, 5 aa, Chlamydia trachomatis
FIVGT

SEQ ID NO: 586 - protein, 5 aa, Chlamydia trachomatis
IVGTN

SEQ ID NO: 587 - protein, 5 aa, Chlamydia trachomatis
VGTNA

SEQ ID NO: 588 - protein, 5 aa, Chlamydia trachomatis
GTNAT

SEQ ID NO: 589 - protein, 5 aa, Chlamydia trachomatis
TNATY

SEQ ID NO: 590 - protein, 5 aa, Chlamydia trachomatis
NATYP

SEQ ID NO: 591 - protein, 5 aa, Chlamydia trachomatis
ATYPP

SEQ ID NO: 592 - protein, 5 aa, Chlamydia trachomatis
TYPPF

SEQ ID NO: 593 - protein, 5 aa, Chlamydia trachomatis
YPPFE

SEQ ID NO: 594 - protein, 5 aa, Chlamydia trachomatis
PPFEF

SEQ ID NO: 595 - protein, 5 aa, Chlamydia trachomatis
PFEFV

SEQ ID NO: 596 - protein, 5 aa, Chlamydia trachomatis
FEFVD

SEQ ID NO: 597 - protein, 5 aa, Chlamydia trachomatis
EFVDK

SEQ ID NO: 598 - protein, 5 aa, Chlamydia trachomatis
FVDKR

SEQ ID NO: 599 - protein, 5 aa, Chlamydia trachomatis
VDKRG

SEQ ID NO: 600 - protein, 5 aa, Chlamydia trachomatis
DKRGE

SEQ ID NO: 601 - protein, 5 aa, Chlamydia trachomatis
KRGEV

SEQ ID NO: 602 - protein, 5 aa, Chlamydia trachomatis
RGEVV

SEQ ID NO: 603 - protein, 5 aa, Chlamydia trachomatis
GEVVG

SEQ ID NO: 604 - protein, 5 aa, Chlamydia trachomatis
EVVGF

SEQ ID NO: 605 - protein, 5 aa, Chlamydia trachomatis
VVGFD

SEQ ID NO: 606 - protein, 5 aa, Chlamydia trachomatis
VGFDI

SEQ ID NO: 607 - protein, 5 aa, Chlamydia trachomatis
GFDID

SEQ ID NO: 608 - protein, 5 aa, Chlamydia trachomatis
FDIDL

SEQ ID NO: 609 - protein, 5 aa, Chlamydia trachomatis
DIDLA

SEQ ID NO: 610 - protein, 5 aa, Chlamydia trachomatis
IDLAR

SEQ ID NO: 611 - protein, 5 aa, Chlamydia trachomatis
DLARE

SEQ ID NO: 612 - protein, 5 aa, Chlamydia trachomatis
LAREI

SEQ ID NO: 613 - protein, 5 aa, Chlamydia trachomatis
AREIS

SEQ ID NO: 614 - protein, 5 aa, Chlamydia trachomatis
REISN

SEQ ID NO: 615 - protein, 5 aa, Chlamydia trachomatis
EISNK

SEQ ID NO: 616 - protein, 5 aa, Chlamydia trachomatis
ISNKL

SEQ ID NO: 617 - protein, 5 aa, Chlamydia trachomatis
SNKLG

SEQ ID NO: 618 - protein, 5 aa, Chlamydia trachomatis
NKLGK

SEQ ID NO: 619 - protein, 5 aa, Chlamydia trachomatis
KLGKT

SEQ ID NO: 620 - protein, 5 aa, Chlamydia trachomatis
LGKTL

SEQ ID NO: 621 - protein, 5 aa, Chlamydia trachomatis
GKTLD

SEQ ID NO: 622 - protein, 5 aa, Chlamydia trachomatis
KTLDV

SEQ ID NO: 623 - protein, 5 aa, Chlamydia trachomatis
TLDVR

SEQ ID NO: 624 - protein, 5 aa, Chlamydia trachomatis
LDVRE

SEQ ID NO: 625 - protein, 5 aa, Chlamydia trachomatis
DVREF

SEQ ID NO: 626 - protein, 5 aa, Chlamydia trachomatis
VREFS

SEQ ID NO: 627 - protein, 5 aa, Chlamydia trachomatis
REFSF

SEQ ID NO: 628 - protein, 5 aa, Chlamydia trachomatis
EFSFD

SEQ ID NO: 629 - protein, 5 aa, Chlamydia trachomatis
FSFDA

SEQ ID NO: 630 - protein, 5 aa, Chlamydia trachomatis
SFDAL

SEQ ID NO: 631 - protein, 5 aa, Chlamydia trachomatis
FDALI

SEQ ID NO: 632 - protein, 5 aa, Chlamydia trachomatis
DALIL

SEQ ID NO: 633 - protein, 5 aa, Chlamydia trachomatis
ALILN

SEQ ID NO: 634 - protein, 5 aa, Chlamydia trachomatis
LILNL

SEQ ID NO: 635 - protein, 5 aa, Chlamydia trachomatis
ILNLK

SEQ ID NO: 636 - protein, 5 aa, Chlamydia trachomatis
LNLKQ

SEQ ID NO: 637 - protein, 5 aa, Chlamydia trachomatis
NLKQH

SEQ ID NO: 638 - protein, 5 aa, Chlamydia trachomatis
LKQHR

SEQ ID NO: 639 - protein, 5 aa, Chlamydia trachomatis
KQHRI

SEQ ID NO: 640 - protein, 5 aa, Chlamydia trachomatis
QHRID

SEQ ID NO: 641 - protein, 5 aa, Chlamydia trachomatis
HRIDA

SEQ ID NO: 642 - protein, 5 aa, Chlamydia trachomatis
RIDAV

SEQ ID NO: 643 - protein, 5 aa, Chlamydia trachomatis
IDAVI

SEQ ID NO: 644 - protein, 5 aa, Chlamydia trachomatis
DAVIT

SEQ ID NO: 645 - protein, 5 aa, Chlamydia trachomatis
AVITG

SEQ ID NO: 646 - protein, 5 aa, Chlamydia trachomatis
VITGM

SEQ ID NO: 647 - protein, 5 aa, Chlamydia trachomatis
ITGMS

SEQ ID NO: 648 - protein, 5 aa, Chlamydia trachomatis
TGMSI

SEQ ID NO: 649 - protein, 5 aa, Chlamydia trachomatis
GMSIT

SEQ ID NO: 650 - protein, 5 aa, Chlamydia trachomatis
MSITP

SEQ ID NO: 651 - protein, 5 aa, Chlamydia trachomatis
SITPS

SEQ ID NO: 652 - protein, 5 aa, Chlamydia trachomatis
ITPSR

SEQ ID NO: 653 - protein, 5 aa, Chlamydia trachomatis
TPSRL

SEQ ID NO: 654 - protein, 5 aa, Chlamydia trachomatis
PSRLK

SEQ ID NO: 655 - protein, 5 aa, Chlamydia trachomatis
SRLKE

SEQ ID NO: 656 - protein, 5 aa, Chlamydia trachomatis
RLKEI

SEQ ID NO: 657 - protein, 5 aa, Chlamydia trachomatis
LKEIL

SEQ ID NO: 658 - protein, 5 aa, Chlamydia trachomatis
KEILM

SEQ ID NO: 659 - protein, 5 aa, Chlamydia trachomatis
EILMI

SEQ ID NO: 660 - protein, 5 aa, Chlamydia trachomatis
ILMIP

SEQ ID NO: 661 - protein, 5 aa, Chlamydia trachomatis
LMIPY

SEQ ID NO: 662 - protein, 5 aa, Chlamydia trachomatis
MIPYY

SEQ ID NO: 663 - protein, 5 aa, Chlamydia trachomatis
IPYYG

SEQ ID NO: 664 - protein, 5 aa, Chlamydia trachomatis
PYYGE

SEQ ID NO: 665 - protein, 5 aa, Chlamydia trachomatis
YYGEE

SEQ ID NO: 666 - protein, 5 aa, Chlamydia trachomatis
YGEEI

SEQ ID NO: 667 - protein, 5 aa, Chlamydia trachomatis
GEEIK

SEQ ID NO: 668 - protein, 5 aa, Chlamydia trachomatis
EEIKH

SEQ ID NO: 669 - protein, 5 aa, Chlamydia trachomatis
EIKHL

SEQ ID NO: 670 - protein, 5 aa, Chlamydia trachomatis
IKHLV

SEQ ID NO: 671 - protein, 5 aa, Chlamydia trachomatis
KHLVL

SEQ ID NO: 672 - protein, 5 aa, Chlamydia trachomatis
HLVLV

SEQ ID NO: 673 - protein, 5 aa, Chlamydia trachomatis
LVLVF

SEQ ID NO: 674 - protein, 5 aa, Chlamydia trachomatis
VLVFK

SEQ ID NO: 675 - protein, 5 aa, Chlamydia trachomatis
LVFKG

SEQ ID NO: 676 - protein, 5 aa, Chlamydia trachomatis
VFKGE

SEQ ID NO: 677 - protein, 5 aa, Chlamydia trachomatis
FKGEN

SEQ ID NO: 678 - protein, 5 aa, Chlamydia trachomatis
KGENK

SEQ ID NO: 679 - protein, 5 aa, Chlamydia trachomatis
GENKH

SEQ ID NO: 680 - protein, 5 aa, Chlamydia trachomatis
ENKHP

SEQ ID NO: 681 - protein, 5 aa, Chlamydia trachomatis
NKHPL

SEQ ID NO: 682 - protein, 5 aa, Chlamydia trachomatis
KHPLP

SEQ ID NO: 683 - protein, 5 aa, Chlamydia trachomatis
HPLPL

SEQ ID NO: 684 - protein, 5 aa, Chlamydia trachomatis
PLPLT

SEQ ID NO: 685 - protein, 5 aa, Chlamydia trachomatis
LPLTQ

SEQ ID NO: 686 - protein, 5 aa, Chlamydia trachomatis
PLTQY

SEQ ID NO: 687 - protein, 5 aa, Chlamydia trachomatis
LTQYR

SEQ ID NO: 688 - protein, 5 aa, Chlamydia trachomatis
TQYRS

SEQ ID NO: 689 - protein, 5 aa, Chlamydia trachomatis
QYRSV

SEQ ID NO: 690 - protein, 5 aa, Chlamydia trachomatis
YRSVA

SEQ ID NO: 691 - protein, 5 aa, Chlamydia trachomatis
RSVAV

SEQ ID NO: 692 - protein, 5 aa, Chlamydia trachomatis
SVAVQ

SEQ ID NO: 693 - protein, 5 aa, Chlamydia trachomatis
VAVQT

SEQ ID NO: 694 - protein, 5 aa, Chlamydia trachomatis
AVQTG

SEQ ID NO: 695 - protein, 5 aa, Chlamydia trachomatis
VQTGT

SEQ ID NO: 696 - protein, 5 aa, Chlamydia trachomatis
QTGTY

SEQ ID NO: 697 - protein, 5 aa, Chlamydia trachomatis
TGTYQ

SEQ ID NO: 698 - protein, 5 aa, Chlamydia trachomatis
GTYQE

SEQ ID NO: 699 - protein, 5 aa, Chlamydia trachomatis
TYQEA

SEQ ID NO: 700 - protein, 5 aa, Chlamydia trachomatis
YQEAY

SEQ ID NO: 701 - protein, 5 aa, Chlamydia trachomatis
QEAYL

SEQ ID NO: 702 - protein, 5 aa, Chlamydia trachomatis
EAYLQ

SEQ ID NO: 703 - protein, 5 aa, Chlamydia trachomatis
AYLQS

SEQ ID NO: 704 - protein, 5 aa, Chlamydia trachomatis
YLQSL

SEQ ID NO: 705 - protein, 5 aa, Chlamydia trachomatis
LQSLS

SEQ ID NO: 706 - protein, 5 aa, Chlamydia trachomatis
QSLSE

SEQ ID NO: 707 - protein, 5 aa, Chlamydia trachomatis
SLSEV

SEQ ID NO: 708 - protein, 5 aa, Chlamydia trachomatis
LSEVH

SEQ ID NO: 709 - protein, 5 aa, Chlamydia trachomatis
SEVHI

SEQ ID NO: 710 - protein, 5 aa, Chlamydia trachomatis
EVHIR

SEQ ID NO: 711 - protein, 5 aa, Chlamydia trachomatis
VHIRS

SEQ ID NO: 712 - protein, 5 aa, Chlamydia trachomatis
HIRSF

SEQ ID NO: 713 - protein, 5 aa, Chlamydia trachomatis
IRSFD

SEQ ID NO: 714 - protein, 5 aa, Chlamydia trachomatis
RSFDS

SEQ ID NO: 715 - protein, 5 aa, Chlamydia trachomatis
SFDST

SEQ ID NO: 716 - protein, 5 aa, Chlamydia trachomatis
FDSTL

SEQ ID NO: 717 - protein, 5 aa, Chlamydia trachomatis
DSTLE

SEQ ID NO: 718 - protein, 5 aa, Chlamydia trachomatis
STLEV

SEQ ID NO: 719 - protein, 5 aa, Chlamydia trachomatis
TLEVL

SEQ ID NO: 720 - protein, 5 aa, Chlamydia trachomatis
LEVLM

SEQ ID NO: 721 - protein, 5 aa, Chlamydia trachomatis
EVLME

SEQ ID NO: 722 - protein, 5 aa, Chlamydia trachomatis
VLMEV

SEQ ID NO: 723 - protein, 5 aa, Chlamydia trachomatis
LMEVM

SEQ ID NO: 724 - protein, 5 aa, Chlamydia trachomatis
MEVMH

SEQ ID NO: 725 - protein, 5 aa, Chlamydia trachomatis
EVMHG

SEQ ID NO: 726 - protein, 5 aa, Chlamydia trachomatis
VMHGK

SEQ ID NO: 727 - protein, 5 aa, Chlamydia trachomatis
MHGKS

SEQ ID NO: 728 - protein, 5 aa, Chlamydia trachomatis
HGKSP

SEQ ID NO: 729 - protein, 5 aa, Chlamydia trachomatis
GKSPV

SEQ ID NO: 730 - protein, 5 aa, Chlamydia trachomatis
KSPVA

SEQ ID NO: 731 - protein, 5 aa, Chlamydia trachomatis
SPVAV

SEQ ID NO: 732 - protein, 5 aa, Chlamydia trachomatis
PVAVL

SEQ ID NO: 733 - protein, 5 aa, Chlamydia trachomatis
VAVLE

SEQ ID NO: 734 - protein, 5 aa, Chlamydia trachomatis
AVLEP

SEQ ID NO: 735 - protein, 5 aa, Chlamydia trachomatis
VLEPS

SEQ ID NO: 736 - protein, 5 aa, Chlamydia trachomatis
LEPSI

SEQ ID NO: 737 - protein, 5 aa, Chlamydia trachomatis
EPSIA

SEQ ID NO: 738 - protein, 5 aa, Chlamydia trachomatis
PSIAQ

SEQ ID NO: 739 - protein, 5 aa, Chlamydia trachomatis
SIAQV

SEQ ID NO: 740 - protein, 5 aa, Chlamydia trachomatis
IAQVV

SEQ ID NO: 741 - protein, 5 aa, Chlamydia trachomatis
AQVVL

SEQ ID NO: 742 - protein, 5 aa, Chlamydia trachomatis
QVVLK

SEQ ID NO: 743 - protein, 5 aa, Chlamydia trachomatis
VVLKD

SEQ ID NO: 744 - protein, 5 aa, Chlamydia trachomatis
VLKDF

SEQ ID NO: 745 - protein, 5 aa, Chlamydia trachomatis
LKDFP

SEQ ID NO: 746 - protein, 5 aa, Chlamydia trachomatis
KDFPA

SEQ ID NO: 747 - protein, 5 aa, Chlamydia trachomatis
DFPAL

SEQ ID NO: 748 - protein, 5 aa, Chlamydia trachomatis
FPALS

SEQ ID NO: 749 - protein, 5 aa, Chlamydia trachomatis
PALST

SEQ ID NO: 750 - protein, 5 aa, Chlamydia trachomatis
ALSTA

SEQ ID NO: 751 - protein, 5 aa, Chlamydia trachomatis
LSTAT

SEQ ID NO: 752 - protein, 5 aa, Chlamydia trachomatis
STATI

SEQ ID NO: 753 - protein, 5 aa, Chlamydia trachomatis
TATID

SEQ ID NO: 754 - protein, 5 aa, Chlamydia trachomatis
ATIDL

SEQ ID NO: 755 - protein, 5 aa, Chlamydia trachomatis
TIDLP

SEQ ID NO: 756 - protein, 5 aa, Chlamydia trachomatis
IDLPE

SEQ ID NO: 757 - protein, 5 aa, Chlamydia trachomatis
DLPED

SEQ ID NO: 758 - protein, 5 aa, Chlamydia trachomatis
LPEDQ

SEQ ID NO: 759 - protein, 5 aa, Chlamydia trachomatis
PEDQW

SEQ ID NO: 760 - protein, 5 aa, Chlamydia trachomatis
EDQWV

SEQ ID NO: 761 - protein, 5 aa, Chlamydia trachomatis
DQWVL

SEQ ID NO: 762 - protein, 5 aa, Chlamydia trachomatis
QWVLG

SEQ ID NO: 763 - protein, 5 aa, Chlamydia trachomatis
WVLGY

SEQ ID NO: 764 - protein, 5 aa, Chlamydia trachomatis
VLGYG

SEQ ID NO: 765 - protein, 5 aa, Chlamydia trachomatis
LGYGI

SEQ ID NO: 766 - protein, 5 aa, Chlamydia trachomatis
GYGIG

SEQ ID NO: 767 - protein, 5 aa, Chlamydia trachomatis
YGIGV

SEQ ID NO: 768 - protein, 5 aa, Chlamydia trachomatis
GIGVA

SEQ ID NO: 769 - protein, 5 aa, Chlamydia trachomatis
IGVAS

SEQ ID NO: 770 - protein, 5 aa, Chlamydia trachomatis
GVASD

SEQ ID NO: 771 - protein, 5 aa, Chlamydia trachomatis
VASDR

SEQ ID NO: 772 - protein, 5 aa, Chlamydia trachomatis
ASDRP

SEQ ID NO: 773 - protein, 5 aa, Chlamydia trachomatis
SDRPA

SEQ ID NO: 774 - protein, 5 aa, Chlamydia trachomatis
DRPAL

SEQ ID NO: 775 - protein, 5 aa, Chlamydia trachomatis
RPALA

SEQ ID NO: 776 - protein, 5 aa, Chlamydia trachomatis
PALAL

SEQ ID NO: 777 - protein, 5 aa, Chlamydia trachomatis
ALALK

SEQ ID NO: 778 - protein, 5 aa, Chlamydia trachomatis
LALKI

SEQ ID NO: 779 - protein, 5 aa, Chlamydia trachomatis
ALKIE

SEQ ID NO: 780 - protein, 5 aa, Chlamydia trachomatis
LKIEA

SEQ ID NO: 781 - protein, 5 aa, Chlamydia trachomatis
KIEAA

SEQ ID NO: 782 - protein, 5 aa, Chlamydia trachomatis
IEAAV

SEQ ID NO: 783 - protein, 5 aa, Chlamydia trachomatis
EAAVQ

SEQ ID NO: 784 - protein, 5 aa, Chlamydia trachomatis
AAVQE

SEQ ID NO: 785 - protein, 5 aa, Chlamydia trachomatis
AVQEI

SEQ ID NO: 786 - protein, 5 aa, Chlamydia trachomatis
VQEIR

SEQ ID NO: 787 - protein, 5 aa, Chlamydia trachomatis
QEIRK

SEQ ID NO: 788 - protein, 5 aa, Chlamydia trachomatis
EIRKE

SEQ ID NO: 789 - protein, 5 aa, Chlamydia trachomatis
IRKEG

SEQ ID NO: 790 - protein, 5 aa, Chlamydia trachomatis
RKEGV

SEQ ID NO: 791 - protein, 5 aa, Chlamydia trachomatis
KEGVL

SEQ ID NO: 792 - protein, 5 aa, Chlamydia trachomatis
EGVLA

SEQ ID NO: 793 - protein, 5 aa, Chlamydia trachomatis
GVLAE

SEQ ID NO: 794 - protein, 5 aa, Chlamydia trachomatis
VLAEL

SEQ ID NO: 795 - protein, 5 aa, Chlamydia trachomatis
LAELE

SEQ ID NO: 796 - protein, 5 aa, Chlamydia trachomatis
AELEQ

SEQ ID NO: 797 - protein, 5 aa, Chlamydia trachomatis
ELEQK

SEQ ID NO: 798 - protein, 5 aa, Chlamydia trachomatis
LEQKW

SEQ ID NO: 799 - protein, 5 aa, Chlamydia trachomatis
EQKWG

SEQ ID NO: 800 - protein, 5 aa, Chlamydia trachomatis
QKWGL

SEQ ID NO: 801 - protein, 5 aa, Chlamydia trachomatis
KWGLN

SEQ ID NO: 802 - protein, 5 aa, Chlamydia trachomatis
WGLNN

SEQ ID NO: 803 - protein, 5 aa, Chlamydia trachomatis
MSIRG

SEQ ID NO: 804 - protein, 5 aa, Chlamydia trachomatis
SIRGV

SEQ ID NO: 805 - protein, 5 aa, Chlamydia trachomatis
IRGVG

SEQ ID NO: 806 - protein, 5 aa, Chlamydia trachomatis
RGVGG

SEQ ID NO: 807 - protein, 5 aa, Chlamydia trachomatis
GVGGN

SEQ ID NO: 808 - protein, 5 aa, Chlamydia trachomatis
VGGNG

SEQ ID NO: 809 - protein, 5 aa, Chlamydia trachomatis
GNGNS

SEQ ID NO: 810 - protein, 5 aa, Chlamydia trachomatis
NGNSR

SEQ ID NO: 811 - protein, 5 aa, Chlamydia trachomatis
GNSRI

SEQ ID NO: 812 - protein, 5 aa, Chlamydia trachomatis
NSRIP

SEQ ID NO: 813 - protein, 5 aa, Chlamydia trachomatis
SRIPS

SEQ ID NO: 814 - protein, 5 aa, Chlamydia trachomatis
RIPSH

SEQ ID NO: 815 - protein, 5 aa, Chlamydia trachomatis
IPSHN

SEQ ID NO: 816 - protein, 5 aa, Chlamydia trachomatis
PSHNG

SEQ ID NO: 817 - protein, 5 aa, Chlamydia trachomatis
SHNGD

SEQ ID NO: 818 - protein, 5 aa, Chlamydia trachomatis
HNGDG

SEQ ID NO: 819 - protein, 5 aa, Chlamydia trachomatis
NGDGS

SEQ ID NO: 820 - protein, 5 aa, Chlamydia trachomatis
GDGSN

SEQ ID NO: 821 - protein, 5 aa, Chlamydia trachomatis
DGSNR

SEQ ID NO: 822 - protein, 5 aa, Chlamydia trachomatis
GSNRR

SEQ ID NO: 823 - protein, 5 aa, Chlamydia trachomatis
SNRRS

SEQ ID NO: 824 - protein, 5 aa, Chlamydia trachomatis
NRRSQ

SEQ ID NO: 825 - protein, 5 aa, Chlamydia trachomatis
RRSQN

SEQ ID NO: 826 - protein, 5 aa, Chlamydia trachomatis
RSQNT

SEQ ID NO: 827 - protein, 5 aa, Chlamydia trachomatis
SQNTK

SEQ ID NO: 828 - protein, 5 aa, Chlamydia trachomatis
QNTKG

SEQ ID NO: 829 - protein, 5 aa, Chlamydia trachomatis
NTKGN

SEQ ID NO: 830 - protein, 5 aa, Chlamydia trachomatis
TKGNN

SEQ ID NO: 831 - protein, 5 aa, Chlamydia trachomatis
KGNNK

SEQ ID NO: 832 - protein, 5 aa, Chlamydia trachomatis
GNNKV

SEQ ID NO: 833 - protein, 5 aa, Chlamydia trachomatis
NNKVE

SEQ ID NO: 834 - protein, 5 aa, Chlamydia trachomatis
NKVED

SEQ ID NO: 835 - protein, 5 aa, Chlamydia trachomatis
KVEDR

SEQ ID NO: 836 - protein, 5 aa, Chlamydia trachomatis
VEDRV

SEQ ID NO: 837 - protein, 5 aa, Chlamydia trachomatis
VEDRV

SEQ ID NO: 838 - protein, 5 aa, Chlamydia trachomatis
EDRVC

SEQ ID NO: 839 - protein, 5 aa, Chlamydia trachomatis
DRVCS

SEQ ID NO: 840 - protein, 5 aa, Chlamydia trachomatis
RVCSL

SEQ ID NO: 841 - protein, 5 aa, Chlamydia trachomatis
VCSLY

SEQ ID NO: 842 - protein, 5 aa, Chlamydia trachomatis
CSLYS

SEQ ID NO: 843 - protein, 5 aa, Chlamydia trachomatis
SLYSS

SEQ ID NO: 844 - protein, 5 aa, Chlamydia trachomatis
LYSSR

SEQ ID NO: 845 - protein, 5 aa, Chlamydia trachomatis
YSSRS

SEQ ID NO: 846 - protein, 5 aa, Chlamydia trachomatis
SSRSN

SEQ ID NO: 847 - protein, 5 aa, Chlamydia trachomatis
SRSNE

SEQ ID NO: 848 - protein, 5 aa, Chlamydia trachomatis
RSNEN

SEQ ID NO: 849 - protein, 5 aa, Chlamydia trachomatis
SNENR

SEQ ID NO: 850 - protein, 5 aa, Chlamydia trachomatis
NENRE

SEQ ID NO: 851 - protein, 5 aa, Chlamydia trachomatis
ENRES

SEQ ID NO: 852 - protein, 5 aa, Chlamydia trachomatis
NRESP

SEQ ID NO: 853 - protein, 5 aa, Chlamydia trachomatis
RESPY

SEQ ID NO: 854 - protein, 5 aa, Chlamydia trachomatis
ESPYA

SEQ ID NO: 855 - protein, 5 aa, Chlamydia trachomatis
SPYAV

SEQ ID NO: 856 - protein, 5 aa, Chlamydia trachomatis
PYAVV

SEQ ID NO: 857 - protein, 5 aa, Chlamydia trachomatis
YAVVD

SEQ ID NO: 858 - protein, 5 aa, Chlamydia trachomatis
AVVDV

SEQ ID NO: 859 - protein, 5 aa, Chlamydia trachomatis
VVDVS

SEQ ID NO: 860 - protein, 5 aa, Chlamydia trachomatis
VDVSS

SEQ ID NO: 861 - protein, 5 aa, Chlamydia trachomatis
DVSSM

SEQ ID NO: 862 - protein, 5 aa, Chlamydia trachomatis
VSSMI

SEQ ID NO: 863 - protein, 5 aa, Chlamydia trachomatis
SSMIE

SEQ ID NO: 864 - protein, 5 aa, Chlamydia trachomatis
SMIES

SEQ ID NO: 865 - protein, 5 aa, Chlamydia trachomatis
MIEST

SEQ ID NO: 866 - protein, 5 aa, Chlamydia trachomatis
IESTP

SEQ ID NO: 867 - protein, 5 aa, Chlamydia trachomatis
ESTPT

SEQ ID NO: 868 - protein, 5 aa, Chlamydia trachomatis
STPTS

SEQ ID NO: 869 - protein, 5 aa, Chlamydia trachomatis
TPTSG

SEQ ID NO: 870 - protein, 5 aa, Chlamydia trachomatis
PTSGE

SEQ ID NO: 871 - protein, 5 aa, Chlamydia trachomatis
TSGET

SEQ ID NO: 872 - protein, 5 aa, Chlamydia trachomatis
SGETT

SEQ ID NO: 873 - protein, 5 aa, Chlamydia trachomatis
GETTR

SEQ ID NO: 874 - protein, 5 aa, Chlamydia trachomatis
ETTRA

SEQ ID NO: 875 - protein, 5 aa, Chlamydia trachomatis
TTRAS

SEQ ID NO: 876 - protein, 5 aa, Chlamydia trachomatis
TRASR

SEQ ID NO: 877 - protein, 5 aa, Chlamydia trachomatis
RASRG

SEQ ID NO: 878 - protein, 5 aa, Chlamydia trachomatis
ASRGV

SEQ ID NO: 879 - protein, 5 aa, Chlamydia trachomatis
SRGVF

SEQ ID NO: 880 - protein, 5 aa, Chlamydia trachomatis
RGVFS

SEQ ID NO: 881 - protein, 5 aa, Chlamydia trachomatis
GVFSR

SEQ ID NO: 882 - protein, 5 aa, Chlamydia trachomatis
VFSRF

SEQ ID NO: 883 - protein, 5 aa, Chlamydia trachomatis
FSRFQ

SEQ ID NO: 884 - protein, 5 aa, Chlamydia trachomatis
SRFQR

SEQ ID NO: 885 - protein, 5 aa, Chlamydia trachomatis
RFQRG

SEQ ID NO: 886 - protein, 5 aa, Chlamydia trachomatis
FQRGL

SEQ ID NO: 887 - protein, 5 aa, Chlamydia trachomatis
QRGLV

SEQ ID NO: 888 - protein, 5 aa, Chlamydia trachomatis
RGLVR

SEQ ID NO: 889 - protein, 5 aa, Chlamydia trachomatis
GLVRV

SEQ ID NO: 890 - protein, 5 aa, Chlamydia trachomatis
LVRVA

SEQ ID NO: 891 - protein, 5 aa, Chlamydia trachomatis
VRVAD

SEQ ID NO: 892 - protein, 5 aa, Chlamydia trachomatis
RVADK

SEQ ID NO: 893 - protein, 5 aa, Chlamydia trachomatis
VADKV

SEQ ID NO: 894 - protein, 5 aa, Chlamydia trachomatis
ADKVR

SEQ ID NO: 895 - protein, 5 aa, Chlamydia trachomatis
DKVRR

SEQ ID NO: 896 - protein, 5 aa, Chlamydia trachomatis
KVRRA

SEQ ID NO: 897 - protein, 5 aa, Chlamydia trachomatis
VRRAV

SEQ ID NO: 898 - protein, 5 aa, Chlamydia trachomatis
RRAVQ

SEQ ID NO: 899 - protein, 5 aa, Chlamydia trachomatis
RAVQC

SEQ ID NO: 900 - protein, 5 aa, Chlamydia trachomatis
AVQCA

SEQ ID NO: 901 - protein, 5 aa, Chlamydia trachomatis
VQCAW

SEQ ID NO: 902 - protein, 5 aa, Chlamydia trachomatis
QCAWS

SEQ ID NO: 903 - protein, 5 aa, Chlamydia trachomatis
CAWSS

SEQ ID NO: 904 - protein, 5 aa, Chlamydia trachomatis
AWSSV

SEQ ID NO: 905 - protein, 5 aa, Chlamydia trachomatis
WSSVS

SEQ ID NO: 906 - protein, 5 aa, Chlamydia trachomatis
SSVST

SEQ ID NO: 907 - protein, 5 aa, Chlamydia trachomatis
SVSTR

SEQ ID NO: 908 - protein, 5 aa, Chlamydia trachomatis
VSTRR

SEQ ID NO: 909 - protein, 5 aa, Chlamydia trachomatis
STRRS

SEQ ID NO: 910 - protein, 5 aa, Chlamydia trachomatis
TRRSS

SEQ ID NO: 911 - protein, 5 aa, Chlamydia trachomatis
RRSSA

SEQ ID NO: 912 - protein, 5 aa, Chlamydia trachomatis
RSSAT

SEQ ID NO: 913 - protein, 5 aa, Chlamydia trachomatis
SSATR

SEQ ID NO: 914 - protein, 5 aa, Chlamydia trachomatis
SATRA

SEQ ID NO: 915 - protein, 5 aa, Chlamydia trachomatis
ATRAA

SEQ ID NO: 916 - protein, 5 aa, Chlamydia trachomatis
TRAAE

SEQ ID NO: 917 - protein, 5 aa, Chlamydia trachomatis
RAAES

SEQ ID NO: 918 - protein, 5 aa, Chlamydia trachomatis
AAESG

SEQ ID NO: 919 - protein, 5 aa, Chlamydia trachomatis
AESGS

SEQ ID NO: 920 - protein, 5 aa, Chlamydia trachomatis
ESGSS

SEQ ID NO: 921 - protein, 5 aa, Chlamydia trachomatis
SGSSS

SEQ ID NO: 922 - protein, 5 aa, Chlamydia trachomatis
GSSSR

SEQ ID NO: 923 - protein, 5 aa, Chlamydia trachomatis
SSSRT

SEQ ID NO: 924 - protein, 5 aa, Chlamydia trachomatis
SSRTA

SEQ ID NO: 925 - protein, 5 aa, Chlamydia trachomatis
SRTAR

SEQ ID NO: 926 - protein, 5 aa, Chlamydia trachomatis
RTARG

SEQ ID NO: 927 - protein, 5 aa, Chlamydia trachomatis
TARGA

SEQ ID NO: 928 - protein, 5 aa, Chlamydia trachomatis
ARGAS

SEQ ID NO: 929 - protein, 5 aa, Chlamydia trachomatis
RGASS

SEQ ID NO: 930 - protein, 5 aa, Chlamydia trachomatis
GASSG

SEQ ID NO: 931 - protein, 5 aa, Chlamydia trachomatis
ASSGY

SEQ ID NO: 932 - protein, 5 aa, Chlamydia trachomatis
SSGYR

SEQ ID NO: 933 - protein, 5 aa, Chlamydia trachomatis
SGYRE

SEQ ID NO: 934 - protein, 5 aa, Chlamydia trachomatis
GYREY

SEQ ID NO: 935 - protein, 5 aa, Chlamydia trachomatis
YREYS

SEQ ID NO: 936 - protein, 5 aa, Chlamydia trachomatis
REYSP

SEQ ID NO: 937 - protein, 5 aa, Chlamydia trachomatis
EYSPS

SEQ ID NO: 938 - protein, 5 aa, Chlamydia trachomatis
YSPSA

SEQ ID NO: 939 - protein, 5 aa, Chlamydia trachomatis
SPSAA

SEQ ID NO: 940 - protein, 5 aa, Chlamydia trachomatis
PSAAR

SEQ ID NO: 941 - protein, 5 aa, Chlamydia trachomatis
SAARG

SEQ ID NO: 942 - protein, 5 aa, Chlamydia trachomatis
AARGL

SEQ ID NO: 943 - protein, 5 aa, Chlamydia trachomatis
ARGLR

SEQ ID NO: 944 - protein, 5 aa, Chlamydia trachomatis
RGLRL

SEQ ID NO: 945 - protein, 5 aa, Chlamydia trachomatis
GLRLM

SEQ ID NO: 946 - protein, 5 aa, Chlamydia trachomatis
LRLMF

SEQ ID NO: 947 - protein, 5 aa, Chlamydia trachomatis
RLMFT

SEQ ID NO: 948 - protein, 5 aa, Chlamydia trachomatis
LMFTD

SEQ ID NO: 949 - protein, 5 aa, Chlamydia trachomatis
MFTDF

SEQ ID NO: 950 - protein, 5 aa, Chlamydia trachomatis
FTDFW

SEQ ID NO: 951 - protein, 5 aa, Chlamydia trachomatis
TDFWR

SEQ ID NO: 952 - protein, 5 aa, Chlamydia trachomatis
DFWRT

SEQ ID NO: 953 - protein, 5 aa, Chlamydia trachomatis
FWRTR

SEQ ID NO: 954 - protein, 5 aa, Chlamydia trachomatis
WRTRV

SEQ ID NO: 955 - protein, 5 aa, Chlamydia trachomatis
RTRVL

SEQ ID NO: 956 - protein, 5 aa, Chlamydia trachomatis
TRVLR

SEQ ID NO: 957 - protein, 5 aa, Chlamydia trachomatis
RVLRQ

SEQ ID NO: 958 - protein, 5 aa, Chlamydia trachomatis
VLRQT

SEQ ID NO: 959 - protein, 5 aa, Chlamydia trachomatis
LRQTS

SEQ ID NO: 960 - protein, 5 aa, Chlamydia trachomatis
RQTSP

SEQ ID NO: 961 - protein, 5 aa, Chlamydia trachomatis
QTSPM

SEQ ID NO: 962 - protein, 5 aa, Chlamydia trachomatis
TSPMA

SEQ ID NO: 963 - protein, 5 aa, Chlamydia trachomatis
SPMAG

SEQ ID NO: 964 - protein, 5 aa, Chlamydia trachomatis
PMAGV

SEQ ID NO: 965 - protein, 5 aa, Chlamydia trachomatis
MAGVF

SEQ ID NO: 966 - protein, 5 aa, Chlamydia trachomatis
AGVFG

SEQ ID NO: 967 - protein, 5 aa, Chlamydia trachomatis
GVFGN

SEQ ID NO: 968 - protein, 5 aa, Chlamydia trachomatis
VFGNL

SEQ ID NO: 969 - protein, 5 aa, Chlamydia trachomatis
FGNLD

SEQ ID NO: 970 - protein, 5 aa, Chlamydia trachomatis
GNLDV

SEQ ID NO: 971 - protein, 5 aa, Chlamydia trachomatis
NLDVN

SEQ ID NO: 972 - protein, 5 aa, Chlamydia trachomatis
LDVNE

SEQ ID NO: 973 - protein, 5 aa, Chlamydia trachomatis
DVNEA

SEQ ID NO: 974 - protein, 5 aa, Chlamydia trachomatis
VNEAR

SEQ ID NO: 975 - protein, 5 aa, Chlamydia trachomatis
NEARL

SEQ ID NO: 976 - protein, 5 aa, Chlamydia trachomatis
EARLM

SEQ ID NO: 977 - protein, 5 aa, Chlamydia trachomatis
ARLMA

SEQ ID NO: 978 - protein, 5 aa, Chlamydia trachomatis
RLMAA

SEQ ID NO: 979 - protein, 5 aa, Chlamydia trachomatis
LMAAY

SEQ ID NO: 980 - protein, 5 aa, Chlamydia trachomatis
MAAYT

SEQ ID NO: 981 - protein, 5 aa, Chlamydia trachomatis
AAYTS

SEQ ID NO: 982 - protein, 5 aa, Chlamydia trachomatis
AYTSE

SEQ ID NO: 983 - protein, 5 aa, Chlamydia trachomatis
YTSEC

SEQ ID NO: 984 - protein, 5 aa, Chlamydia trachomatis
TSECA

SEQ ID NO: 985 - protein, 5 aa, Chlamydia trachomatis
SECAD

SEQ ID NO: 986 - protein, 5 aa, Chlamydia trachomatis
ECADH

SEQ ID NO: 987 - protein, 5 aa, Chlamydia trachomatis
CADHL

SEQ ID NO: 988 - protein, 5 aa, Chlamydia trachomatis
ADHLE

SEQ ID NO: 989 - protein, 5 aa, Chlamydia trachomatis
DHLEA

SEQ ID NO: 990 - protein, 5 aa, Chlamydia trachomatis
HLEAN

SEQ ID NO: 991 - protein, 5 aa, Chlamydia trachomatis
LEANK

SEQ ID NO: 992 - protein, 5 aa, Chlamydia trachomatis
EANKL

SEQ ID NO: 993 - protein, 5 aa, Chlamydia trachomatis
ANKLA

SEQ ID NO: 994 - protein, 5 aa, Chlamydia trachomatis
NKLAG

SEQ ID NO: 995 - protein, 5 aa, Chlamydia trachomatis
KLAGP

SEQ ID NO: 996 - protein, 5 aa, Chlamydia trachomatis
LAGPD

SEQ ID NO: 997 - protein, 5 aa, Chlamydia trachomatis
AGPDG

SEQ ID NO: 998 - protein, 5 aa, Chlamydia trachomatis
GPDGV

SEQ ID NO: 999 - protein, 5 aa, Chlamydia trachomatis
PDGVA

SEQ ID NO: 1000 - protein, 5 aa, Chlamydia trachomatis
DGVAA

SEQ ID NO: 1001 - protein, 5 aa, Chlamydia trachomatis
GVAAA

SEQ ID NO: 1002 - protein, 5 aa, Chlamydia trachomatis
VAAAR

SEQ ID NO: 1003 - protein, 5 aa, Chlamydia trachomatis
AAARE

SEQ ID NO: 1004 - protein, 5 aa, Chlamydia trachomatis
AAREI

SEQ ID NO: 1005 - protein, 5 aa, Chlamydia trachomatis
AREIA

SEQ ID NO: 1006 - protein, 5 aa, Chlamydia trachomatis
REIAK

SEQ ID NO: 1007 - protein, 5 aa, Chlamydia trachomatis
EIAKR

SEQ ID NO: 1008 - protein, 5 aa, Chlamydia trachomatis
IAKRW

SEQ ID NO: 1009 - protein, 5 aa, Chlamydia trachomatis
AKRWE

SEQ ID NO: 1010 - protein, 5 aa, Chlamydia trachomatis
KRWEQ

SEQ ID NO: 1011 - protein, 5 aa, Chlamydia trachomatis
RWEQR

SEQ ID NO: 1012 - protein, 5 aa, Chlamydia trachomatis
WEQRV

SEQ ID NO: 1013 - protein, 5 aa, Chlamydia trachomatis
EQRVR

SEQ ID NO: 1014 - protein, 5 aa, Chlamydia trachomatis
QRVRD

SEQ ID NO: 1015 - protein, 5 aa, Chlamydia trachomatis
RVRDL

SEQ ID NO: 1016 - protein, 5 aa, Chlamydia trachomatis
VRDLQ

SEQ ID NO: 1017 - protein, 5 aa, Chlamydia trachomatis
RDLQD

SEQ ID NO: 1018 - protein, 5 aa, Chlamydia trachomatis
DLQDK

SEQ ID NO: 1019 - protein, 5 aa, Chlamydia trachomatis
LQDKG

SEQ ID NO: 1020 - protein, 5 aa, Chlamydia trachomatis
QDKGA

SEQ ID NO: 1021 - protein, 5 aa, Chlamydia trachomatis
DKGAA

SEQ ID NO: 1022 - protein, 5 aa, Chlamydia trachomatis
KGAAR

SEQ ID NO: 1023 - protein, 5 aa, Chlamydia trachomatis
GAARK

SEQ ID NO: 1024 - protein, 5 aa, Chlamydia trachomatis
AARKL

SEQ ID NO: 1025 - protein, 5 aa, Chlamydia trachomatis
ARKLL

SEQ ID NO: 1026 - protein, 5 aa, Chlamydia trachomatis
RKLLN

SEQ ID NO: 1027 - protein, 5 aa, Chlamydia trachomatis
KLLND

SEQ ID NO: 1028 - protein, 5 aa, Chlamydia trachomatis
LLNDP

SEQ ID NO: 1029 - protein, 5 aa, Chlamydia trachomatis
LNDPL

SEQ ID NO: 1030 - protein, 5 aa, Chlamydia trachomatis
NDPLG

SEQ ID NO: 1031 - protein, 5 aa, Chlamydia trachomatis
DPLGR

SEQ ID NO: 1032 - protein, 5 aa, Chlamydia trachomatis
PLGRR

SEQ ID NO: 1033 - protein, 5 aa, Chlamydia trachomatis
LGRRT

SEQ ID NO: 1034 - protein, 5 aa, Chlamydia trachomatis
GRRTP

SEQ ID NO: 1035 - protein, 5 aa, Chlamydia trachomatis
RRTPN

SEQ ID NO: 1036 - protein, 5 aa, Chlamydia trachomatis
RTPNY

SEQ ID NO: 1037 - protein, 5 aa, Chlamydia trachomatis
TPNYQ

SEQ ID NO: 1038 - protein, 5 aa, Chlamydia trachomatis
PNYQS

SEQ ID NO: 1039 - protein, 5 aa, Chlamydia trachomatis
NYQSK

SEQ ID NO: 1040 - protein, 5 aa, Chlamydia trachomatis
YQSKN

SEQ ID NO: 1041 - protein, 5 aa, Chlamydia trachomatis
QSKNP

SEQ ID NO: 1042 - protein, 5 aa, Chlamydia trachomatis
SKNPG

SEQ ID NO: 1043 - protein, 5 aa, Chlamydia trachomatis
KNPGE

SEQ ID NO: 1044 - protein, 5 aa, Chlamydia trachomatis
NPGEY

SEQ ID NO: 1045 - protein, 5 aa, Chlamydia trachomatis
PGEYT

SEQ ID NO: 1046 - protein, 5 aa, Chlamydia trachomatis
GEYTV

SEQ ID NO: 1047 - protein, 5 aa, Chlamydia trachomatis
EYTVG

SEQ ID NO: 1048 - protein, 5 aa, Chlamydia trachomatis
YTVGN

SEQ ID NO: 1049 - protein, 5 aa, Chlamydia trachomatis
TVGNS

SEQ ID NO: 1050 - protein, 5 aa, Chlamydia trachomatis
VGNSM

SEQ ID NO: 1051 - protein, 5 aa, Chlamydia trachomatis
GNSMF

SEQ ID NO: 1052 - protein, 5 aa, Chlamydia trachomatis
NSMFY

SEQ ID NO: 1053 - protein, 5 aa, Chlamydia trachomatis
SMFYD

SEQ ID NO: 1054 - protein, 5 aa, Chlamydia trachomatis
MFYDG

SEQ ID NO: 1055 - protein, 5 aa, Chlamydia trachomatis
FYDGP

SEQ ID NO: 1056 - protein, 5 aa, Chlamydia trachomatis
YDGPQ

SEQ ID NO: 1057 - protein, 5 aa, Chlamydia trachomatis
DGPQV

SEQ ID NO: 1058 - protein, 5 aa, Chlamydia trachomatis
GPQVA

SEQ ID NO: 1059 - protein, 5 aa, Chlamydia trachomatis
PQVAN

SEQ ID NO: 1060 - protein, 5 aa, Chlamydia trachomatis
QVANL

SEQ ID NO: 1061 - protein, 5 aa, Chlamydia trachomatis
VANLQ

SEQ ID NO: 1062 - protein, 5 aa, Chlamydia trachomatis
ANLQN

SEQ ID NO: 1063 - protein, 5 aa, Chlamydia trachomatis
NLQNV

SEQ ID NO: 1064 - protein, 5 aa, Chlamydia trachomatis
LQNVD

SEQ ID NO: 1065 - protein, 5 aa, Chlamydia trachomatis
QNVDT

SEQ ID NO: 1066 - protein, 5 aa, Chlamydia trachomatis
NVDTG

SEQ ID NO: 1067 - protein, 5 aa, Chlamydia trachomatis
VDTGF

SEQ ID NO: 1068 - protein, 5 aa, Chlamydia trachomatis
DTGFW

SEQ ID NO: 1069 - protein, 5 aa, Chlamydia trachomatis
TGFWL

SEQ ID NO: 1070 - protein, 5 aa, Chlamydia trachomatis
GFWLD

SEQ ID NO: 1071 - protein, 5 aa, Chlamydia trachomatis
FWLDM

SEQ ID NO: 1072 - protein, 5 aa, Chlamydia trachomatis
WLDMS

SEQ ID NO: 1073 - protein, 5 aa, Chlamydia trachomatis
LDMSN

SEQ ID NO: 1074 - protein, 5 aa, Chlamydia trachomatis
DMSNL

SEQ ID NO: 1075 - protein, 5 aa, Chlamydia trachomatis
MSNLS

SEQ ID NO: 1076 - protein, 5 aa, Chlamydia trachomatis
SNLSD

SEQ ID NO: 1077 - protein, 5 aa, Chlamydia trachomatis
NLSDV

SEQ ID NO: 1078 - protein, 5 aa, Chlamydia trachomatis
LSDVV

SEQ ID NO: 1079 - protein, 5 aa, Chlamydia trachomatis
SDVVL

SEQ ID NO: 1080 - protein, 5 aa, Chlamydia trachomatis
DVVLS

SEQ ID NO: 1081 - protein, 5 aa, Chlamydia trachomatis
VVLSR

SEQ ID NO: 1082 - protein, 5 aa, Chlamydia trachomatis
VLSRE

SEQ ID NO: 1083 - protein, 5 aa, Chlamydia trachomatis
LSREI

SEQ ID NO: 1084 - protein, 5 aa, Chlamydia trachomatis
SREIQ

SEQ ID NO: 1085 - protein, 5 aa, Chlamydia trachomatis
REIQT

SEQ ID NO: 1086 - protein, 5 aa, Chlamydia trachomatis
EIQTG

SEQ ID NO: 1087 - protein, 5 aa, Chlamydia trachomatis
IQTGL

SEQ ID NO: 1088 - protein, 5 aa, Chlamydia trachomatis
QTGLR

SEQ ID NO: 1089 - protein, 5 aa, Chlamydia trachomatis
TGLRA

SEQ ID NO: 1090 - protein, 5 aa, Chlamydia trachomatis
GLRAR

SEQ ID NO: 1091 - protein, 5 aa, Chlamydia trachomatis
LRARA

SEQ ID NO: 1092 - protein, 5 aa, Chlamydia trachomatis
RARAT

SEQ ID NO: 1093 - protein, 5 aa, Chlamydia trachomatis
ARATL

SEQ ID NO: 1094 - protein, 5 aa, Chlamydia trachomatis
RATLE

SEQ ID NO: 1095 - protein, 5 aa, Chlamydia trachomatis
ATLEE

SEQ ID NO: 1096 - protein, 5 aa, Chlamydia trachomatis
TLEES

SEQ ID NO: 1097 - protein, 5 aa, Chlamydia trachomatis
LEESM

SEQ ID NO: 1098 - protein, 5 aa, Chlamydia trachomatis
EESMP

SEQ ID NO: 1099 - protein, 5 aa, Chlamydia trachomatis
ESMPM

SEQ ID NO: 1100 - protein, 5 aa, Chlamydia trachomatis
SMPML

SEQ ID NO: 1101 - protein, 5 aa, Chlamydia trachomatis
MPMLE

SEQ ID NO: 1102 - protein, 5 aa, Chlamydia trachomatis
PMLEN

SEQ ID NO: 1103 - protein, 5 aa, Chlamydia trachomatis
MLENL

SEQ ID NO: 1104 - protein, 5 aa, Chlamydia trachomatis
LENLE

SEQ ID NO: 1105 - protein, 5 aa, Chlamydia trachomatis
ENLEE

SEQ ID NO: 1106 - protein, 5 aa, Chlamydia trachomatis
NLEER

SEQ ID NO: 1107 - protein, 5 aa, Chlamydia trachomatis
LEERF

SEQ ID NO: 1108 - protein, 5 aa, Chlamydia trachomatis
EERFR

SEQ ID NO: 1109 - protein, 5 aa, Chlamydia trachomatis
ERFRR

SEQ ID NO: 1110 - protein, 5 aa, Chlamydia trachomatis
RFRRL

SEQ ID NO: 1111 - protein, 5 aa, Chlamydia trachomatis
FRRLQ

SEQ ID NO: 1112 - protein, 5 aa, Chlamydia trachomatis
RRLQE

SEQ ID NO: 1113 - protein, 5 aa, Chlamydia trachomatis
RLQET

SEQ ID NO: 1114 - protein, 5 aa, Chlamydia trachomatis
LQETC

SEQ ID NO: 1115 - protein, 5 aa, Chlamydia trachomatis
QETCD

SEQ ID NO: 1116 - protein, 5 aa, Chlamydia trachomatis
ETCDA

SEQ ID NO: 1117 - protein, 5 aa, Chlamydia trachomatis
TCDAA

SEQ ID NO: 1118 - protein, 5 aa, Chlamydia trachomatis
CDAAR

SEQ ID NO: 1119 - protein, 5 aa, Chlamydia trachomatis
DAART

SEQ ID NO: 1120 - protein, 5 aa, Chlamydia trachomatis
AARTE

SEQ ID NO: 1121 - protein, 5 aa, Chlamydia trachomatis
ARTEI

SEQ ID NO: 1122 - protein, 5 aa, Chlamydia trachomatis
RTEIE

SEQ ID NO: 1123 - protein, 5 aa, Chlamydia trachomatis
TEIEE

SEQ ID NO: 1124 - protein, 5 aa, Chlamydia trachomatis
EIEES

SEQ ID NO: 1125 - protein, 5 aa, Chlamydia trachomatis
IEESG

SEQ ID NO: 1126 - protein, 5 aa, Chlamydia trachomatis
EESGW

SEQ ID NO: 1127 - protein, 5 aa, Chlamydia trachomatis
ESGWT

SEQ ID NO: 1128 - protein, 5 aa, Chlamydia trachomatis
SGWTR

SEQ ID NO: 1129 - protein, 5 aa, Chlamydia trachomatis
GWTRE

SEQ ID NO: 1130 - protein, 5 aa, Chlamydia trachomatis
WTRES

SEQ ID NO: 1131 - protein, 5 aa, Chlamydia trachomatis
TRESA

SEQ ID NO: 1132 - protein, 5 aa, Chlamydia trachomatis
RESAS

SEQ ID NO: 1133 - protein, 5 aa, Chlamydia trachomatis
ESASR

SEQ ID NO: 1134 - protein, 5 aa, Chlamydia trachomatis
SASRM

SEQ ID NO: 1135 - protein, 5 aa, Chlamydia trachomatis
ASRME

SEQ ID NO: 1136 - protein, 5 aa, Chlamydia trachomatis
SRMEG

SEQ ID NO: 1137 - protein, 5 aa, Chlamydia trachomatis
RMEGD

SEQ ID NO: 1138 - protein, 5 aa, Chlamydia trachomatis
MEGDE

SEQ ID NO: 1139 - protein, 5 aa, Chlamydia trachomatis
EGDEA

SEQ ID NO: 1140 - protein, 5 aa, Chlamydia trachomatis
GDEAQ

SEQ ID NO: 1141 - protein, 5 aa, Chlamydia trachomatis
DEAQG

SEQ ID NO: 1142 - protein, 5 aa, Chlamydia trachomatis
EAQGP

SEQ ID NO: 1143 - protein, 5 aa, Chlamydia trachomatis
AQGPS

SEQ ID NO: 1144 - protein, 5 aa, Chlamydia trachomatis
QGPSR

SEQ ID NO: 1145 - protein, 5 aa, Chlamydia trachomatis
GPSRA

SEQ ID NO: 1146 - protein, 5 aa, Chlamydia trachomatis
PSRAQ

SEQ ID NO: 1147 - protein, 5 aa, Chlamydia trachomatis
SRAQQ

SEQ ID NO: 1148 - protein, 5 aa, Chlamydia trachomatis
RAQQA

SEQ ID NO: 1149 - protein, 5 aa, Chlamydia trachomatis
AQQAF

SEQ ID NO: 1150 - protein, 5 aa, Chlamydia trachomatis
QQAFQ

SEQ ID NO: 1151 - protein, 5 aa, Chlamydia trachomatis
QAFQS

SEQ ID NO: 1152 - protein, 5 aa, Chlamydia trachomatis
AFQSF

SEQ ID NO: 1153 - protein, 5 aa, Chlamydia trachomatis
FQSFV

SEQ ID NO: 1154 - protein, 5 aa, Chlamydia trachomatis
QSFVN

SEQ ID NO: 1155 - protein, 5 aa, Chlamydia trachomatis
SFVNE

SEQ ID NO: 1156 - protein, 5 aa, Chlamydia trachomatis
FVNEC

SEQ ID NO: 1157 - protein, 5 aa, Chlamydia trachomatis
VNECN

SEQ ID NO: 1158 - protein, 5 aa, Chlamydia trachomatis
NECNS

SEQ ID NO: 1159 - protein, 5 aa, Chlamydia trachomatis
ECNSI

SEQ ID NO: 1160 - protein, 5 aa, Chlamydia trachomatis
CNSIE

SEQ ID NO: 1161 - protein, 5 aa, Chlamydia trachomatis
NSIEF

SEQ ID NO: 1162 - protein, 5 aa, Chlamydia trachomatis
SIEFS

SEQ ID NO: 1163 - protein, 5 aa, Chlamydia trachomatis
IEFSF

SEQ ID NO: 1164 - protein, 5 aa, Chlamydia trachomatis
EFSFG

SEQ ID NO: 1165 - protein, 5 aa, Chlamydia trachomatis
FSFGS

SEQ ID NO: 1166 - protein, 5 aa, Chlamydia trachomatis
SFGSF

SEQ ID NO: 1167 - protein, 5 aa, Chlamydia trachomatis
FGSFG

SEQ ID NO: 1168 - protein, 5 aa, Chlamydia trachomatis
GSFGE

SEQ ID NO: 1169 - protein, 5 aa, Chlamydia trachomatis
SFGEH

SEQ ID NO: 1170 - protein, 5 aa, Chlamydia trachomatis
FGEHV

SEQ ID NO: 1171 - protein, 5 aa, Chlamydia trachomatis
GEHVR

SEQ ID NO: 1172 - protein, 5 aa, Chlamydia trachomatis
EHVRV

SEQ ID NO: 1173 - protein, 5 aa, Chlamydia trachomatis
HVRVL

SEQ ID NO: 1174 - protein, 5 aa, Chlamydia trachomatis
VRVLC

SEQ ID NO: 1175 - protein, 5 aa, Chlamydia trachomatis
RVLCA

SEQ ID NO: 1176 - protein, 5 aa, Chlamydia trachomatis
VLCAR

SEQ ID NO: 1177 - protein, 5 aa, Chlamydia trachomatis
LCARV

SEQ ID NO: 1178 - protein, 5 aa, Chlamydia trachomatis
CARVS

SEQ ID NO: 1179 - protein, 5 aa, Chlamydia trachomatis
ARVSR

SEQ ID NO: 1180 - protein, 5 aa, Chlamydia trachomatis
RVSRG

SEQ ID NO: 1181 - protein, 5 aa, Chlamydia trachomatis
VSRGL

SEQ ID NO: 1182 - protein, 5 aa, Chlamydia trachomatis
SRGLA

SEQ ID NO: 1183 - protein, 5 aa, Chlamydia trachomatis
RGLAA

SEQ ID NO: 1184 - protein, 5 aa, Chlamydia trachomatis
GLAAA

SEQ ID NO: 1185 - protein, 5 aa, Chlamydia trachomatis
LAAAG

SEQ ID NO: 1186 - protein, 5 aa, Chlamydia trachomatis
AAAGE

SEQ ID NO: 1187 - protein, 5 aa, Chlamydia trachomatis
AAGEA

SEQ ID NO: 1188 - protein, 5 aa, Chlamydia trachomatis
AGEAI

SEQ ID NO: 1189 - protein, 5 aa, Chlamydia trachomatis
GEAIR

SEQ ID NO: 1190 - protein, 5 aa, Chlamydia trachomatis
EAIRR

SEQ ID NO: 1191 - protein, 5 aa, Chlamydia trachomatis
AIRRC

SEQ ID NO: 1192 - protein, 5 aa, Chlamydia trachomatis
IRRCF

SEQ ID NO: 1193 - protein, 5 aa, Chlamydia trachomatis
RRCFS

SEQ ID NO: 1194 - protein, 5 aa, Chlamydia trachomatis
RCFSC

SEQ ID NO: 1195 - protein, 5 aa, Chlamydia trachomatis
CFSCC

SEQ ID NO: 1196 - protein, 5 aa, Chlamydia trachomatis
FSCCK

SEQ ID NO: 1197 - protein, 5 aa, Chlamydia trachomatis
SCCKG

SEQ ID NO: 1198 - protein, 5 aa, Chlamydia trachomatis
CCKGS

SEQ ID NO: 1199 - protein, 5 aa, Chlamydia trachomatis
CKGST

SEQ ID NO: 1200 - protein, 5 aa, Chlamydia trachomatis
KGSTH

SEQ ID NO: 1201 - protein, 5 aa, Chlamydia trachomatis
GSTHR

SEQ ID NO: 1202 - protein, 5 aa, Chlamydia trachomatis
STHRY

SEQ ID NO: 1203 - protein, 5 aa, Chlamydia trachomatis
THRYA

SEQ ID NO: 1204 - protein, 5 aa, Chlamydia trachomatis
HRYAP

SEQ ID NO: 1205 - protein, 5 aa, Chlamydia trachomatis
RYAPR

SEQ ID NO: 1206 - protein, 5 aa, Chlamydia trachomatis
YAPRD

SEQ ID NO: 1207 - protein, 5 aa, Chlamydia trachomatis
APRDD

SEQ ID NO: 1208 - protein, 5 aa, Chlamydia trachomatis
PRDDL

SEQ ID NO: 1209 - protein, 5 aa, Chlamydia trachomatis
RDDLS

SEQ ID NO: 1210 - protein, 5 aa, Chlamydia trachomatis
DDLSP

SEQ ID NO: 1211 - protein, 5 aa, Chlamydia trachomatis
DLSPE

SEQ ID NO: 1212 - protein, 5 aa, Chlamydia trachomatis
LSPEG

SEQ ID NO: 1213 - protein, 5 aa, Chlamydia trachomatis
SPEGA

SEQ ID NO: 1214 - protein, 5 aa, Chlamydia trachomatis
PEGAS

SEQ ID NO: 1215 - protein, 5 aa, Chlamydia trachomatis
EGASL

SEQ ID NO: 1216 - protein, 5 aa, Chlamydia trachomatis
GASLA

SEQ ID NO: 1217 - protein, 5 aa, Chlamydia trachomatis
ASLAE

SEQ ID NO: 1218 - protein, 5 aa, Chlamydia trachomatis
SLAET

SEQ ID NO: 1219 - protein, 5 aa, Chlamydia trachomatis
LAETL

SEQ ID NO: 1220 - protein, 5 aa, Chlamydia trachomatis
AETLA

SEQ ID NO: 1221 - protein, 5 aa, Chlamydia trachomatis
ETLAR

SEQ ID NO: 1222 - protein, 5 aa, Chlamydia trachomatis
TLARF

SEQ ID NO: 1223 - protein, 5 aa, Chlamydia trachomatis
LARFA

SEQ ID NO: 1224 - protein, 5 aa, Chlamydia trachomatis
ARFAD

SEQ ID NO: 1225 - protein, 5 aa, Chlamydia trachomatis
RFADD

SEQ ID NO: 1226 - protein, 5 aa, Chlamydia trachomatis
FADDM

SEQ ID NO: 1227 - protein, 5 aa, Chlamydia trachomatis
ADDMG

SEQ ID NO: 1228 - protein, 5 aa, Chlamydia trachomatis
DDMGI

SEQ ID NO: 1229 - protein, 5 aa, Chlamydia trachomatis
DMGIE

SEQ ID NO: 1230 - protein, 5 aa, Chlamydia trachomatis
MGIER

SEQ ID NO: 1231 - protein, 5 aa, Chlamydia trachomatis
GIERG

SEQ ID NO: 1232 - protein, 5 aa, Chlamydia trachomatis
IERGA

SEQ ID NO: 1233 - protein, 5 aa, Chlamydia trachomatis
ERGAD

SEQ ID NO: 1234 - protein, 5 aa, Chlamydia trachomatis
RGADG

SEQ ID NO: 1235 - protein, 5 aa, Chlamydia trachomatis
GADGT

SEQ ID NO: 1236 - protein, 5 aa, Chlamydia trachomatis
ADGTY

SEQ ID NO: 1237 - protein, 5 aa, Chlamydia trachomatis
DGTYD

SEQ ID NO: 1238 - protein, 5 aa, Chlamydia trachomatis
GTYDI

SEQ ID NO: 1239 - protein, 5 aa, Chlamydia trachomatis
TYDIP

SEQ ID NO: 1240 - protein, 5 aa, Chlamydia trachomatis
YDIPL

SEQ ID NO: 1241 - protein, 5 aa, Chlamydia trachomatis
DIPLV

SEQ ID NO: 1242 - protein, 5 aa, Chlamydia trachomatis
IPLVD

SEQ ID NO: 1243 - protein, 5 aa, Chlamydia trachomatis
PLVDD

SEQ ID NO: 1244 - protein, 5 aa, Chlamydia trachomatis
LVDDW

SEQ ID NO: 1245 - protein, 5 aa, Chlamydia trachomatis
VDDWR

SEQ ID NO: 1246 - protein, 5 aa, Chlamydia trachomatis
DDWRR

SEQ ID NO: 1247 - protein, 5 aa, Chlamydia trachomatis
DWRRG

SEQ ID NO: 1248 - protein, 5 aa, Chlamydia trachomatis
WRRGV

SEQ ID NO: 1249 - protein, 5 aa, Chlamydia trachomatis
RRGVP

SEQ ID NO: 1250 - protein, 5 aa, Chlamydia trachomatis
RGVPS

SEQ ID NO: 1251 - protein, 5 aa, Chlamydia trachomatis
GVPSI

SEQ ID NO: 1252 - protein, 5 aa, Chlamydia trachomatis
VPSIE

SEQ ID NO: 1253 - protein, 5 aa, Chlamydia trachomatis
PSIEG

SEQ ID NO: 1254 - protein, 5 aa, Chlamydia trachomatis
SIEGE

SEQ ID NO: 1255 - protein, 5 aa, Chlamydia trachomatis
IEGEG

SEQ ID NO: 1256 - protein, 5 aa, Chlamydia trachomatis
EGEGS

SEQ ID NO: 1257 - protein, 5 aa, Chlamydia trachomatis
GEGSD

SEQ ID NO: 1258 - protein, 5 aa, Chlamydia trachomatis
EGSDS

SEQ ID NO: 1259 - protein, 5 aa, Chlamydia trachomatis
GSDSI

SEQ ID NO: 1260 - protein, 5 aa, Chlamydia trachomatis
SDSIY

SEQ ID NO: 1261 - protein, 5 aa, Chlamydia trachomatis
DSIYE

SEQ ID NO: 1262 - protein, 5 aa, Chlamydia trachomatis
SIYEI

SEQ ID NO: 1263 - protein, 5 aa, Chlamydia trachomatis
IYEIM

SEQ ID NO: 1264 - protein, 5 aa, Chlamydia trachomatis
YEIMM

SEQ ID NO: 1265 - protein, 5 aa, Chlamydia trachomatis
EIMMP

SEQ ID NO: 1266 - protein, 5 aa, Chlamydia trachomatis
IMMPI

SEQ ID NO: 1267 - protein, 5 aa, Chlamydia trachomatis
MMPIY

SEQ ID NO: 1268 - protein, 5 aa, Chlamydia trachomatis
MPIYE

SEQ ID NO: 1269 - protein, 5 aa, Chlamydia trachomatis
PIYEV

SEQ ID NO: 1270 - protein, 5 aa, Chlamydia trachomatis
IYEVM

SEQ ID NO: 1271 - protein, 5 aa, Chlamydia trachomatis
YEVMD

SEQ ID NO: 1272 - protein, 5 aa, Chlamydia trachomatis
EVMDM

SEQ ID NO: 1273 - protein, 5 aa, Chlamydia trachomatis
VMDMD

SEQ ID NO: 1274 - protein, 5 aa, Chlamydia trachomatis
MDMDL

SEQ ID NO: 1275 - protein, 5 aa, Chlamydia trachomatis
DMDLE

SEQ ID NO: 1276 - protein, 5 aa, Chlamydia trachomatis
MDLET

SEQ ID NO: 1277 - protein, 5 aa, Chlamydia trachomatis
DLETR

SEQ ID NO: 1278 - protein, 5 aa, Chlamydia trachomatis
LETRR

SEQ ID NO: 1279 - protein, 5 aa, Chlamydia trachomatis
ETRRS

SEQ ID NO: 1280 - protein, 5 aa, Chlamydia trachomatis
TRRSF

SEQ ID NO: 1281 - protein, 5 aa, Chlamydia trachomatis
RRSFA

SEQ ID NO: 1282 - protein, 5 aa, Chlamydia trachomatis
RSFAV

SEQ ID NO: 1283 - protein, 5 aa, Chlamydia trachomatis
SFAVQ

SEQ ID NO: 1284 - protein, 5 aa, Chlamydia trachomatis
FAVQQ

SEQ ID NO: 1285 - protein, 5 aa, Chlamydia trachomatis
AVQQG

SEQ ID NO: 1286 - protein, 5 aa, Chlamydia trachomatis
VQQGH

SEQ ID NO: 1287 - protein, 5 aa, Chlamydia trachomatis
QQGHY

SEQ ID NO: 1288 - protein, 5 aa, Chlamydia trachomatis
QGHYQ

SEQ ID NO: 1289 - protein, 5 aa, Chlamydia trachomatis
GHYQD

SEQ ID NO: 1290 - protein, 5 aa, Chlamydia trachomatis
HYQDP

SEQ ID NO: 1291 - protein, 5 aa, Chlamydia trachomatis
YQDPR

SEQ ID NO: 1292 - protein, 5 aa, Chlamydia trachomatis
QDPRA

SEQ ID NO: 1293 - protein, 5 aa, Chlamydia trachomatis
DPRAS

SEQ ID NO: 1294 - protein, 5 aa, Chlamydia trachomatis
PRASD

SEQ ID NO: 1295 - protein, 5 aa, Chlamydia trachomatis
RASDY

SEQ ID NO: 1296 - protein, 5 aa, Chlamydia trachomatis
ASDYD

SEQ ID NO: 1297 - protein, 5 aa, Chlamydia trachomatis
SDYDL

SEQ ID NO: 1298 - protein, 5 aa, Chlamydia trachomatis
DYDLP

SEQ ID NO: 1299 - protein, 5 aa, Chlamydia trachomatis
YDLPR

SEQ ID NO: 1300 - protein, 5 aa, Chlamydia trachomatis
DLPRA

SEQ ID NO: 1301 - protein, 5 aa, Chlamydia trachomatis
LPRAS

SEQ ID NO: 1302 - protein, 5 aa, Chlamydia trachomatis
PRASD

SEQ ID NO: 1303 - protein, 5 aa, Chlamydia trachomatis
RASDY

SEQ ID NO: 1304 - protein, 5 aa, Chlamydia trachomatis
ASDYD

SEQ ID NO: 1305 - protein, 5 aa, Chlamydia trachomatis
SDYDL

SEQ ID NO: 1306 - protein, 5 aa, Chlamydia trachomatis
DYDLP

SEQ ID NO: 1307 - protein, 5 aa, Chlamydia trachomatis
YDLPR

SEQ ID NO: 1308 - protein, 5 aa, Chlamydia trachomatis
DLPRS

SEQ ID NO: 1309 - protein, 5 aa, Chlamydia trachomatis
LPRSP

SEQ ID NO: 1310 - protein, 5 aa, Chlamydia trachomatis
PRSPY

SEQ ID NO: 1311 - protein, 5 aa, Chlamydia trachomatis
RSPYP

SEQ ID NO: 1312 - protein, 5 aa, Chlamydia trachomatis
SPYPT

SEQ ID NO: 1313 - protein, 5 aa, Chlamydia trachomatis
PYPTP

SEQ ID NO: 1314 - protein, 5 aa, Chlamydia trachomatis
YPTPP

SEQ ID NO: 1315 - protein, 5 aa, Chlamydia trachomatis
PTPPL

SEQ ID NO: 1316 - protein, 5 aa, Chlamydia trachomatis
TPPLP

SEQ ID NO: 1317 - protein, 5 aa, Chlamydia trachomatis
PPLPP

SEQ ID NO: 1318 - protein, 5 aa, Chlamydia trachomatis
PLPPR

SEQ ID NO: 1319 - protein, 5 aa, Chlamydia trachomatis
LPPRY

SEQ ID NO: 1320 - protein, 5 aa, Chlamydia trachomatis
PPRYQ

SEQ ID NO: 1321 - protein, 5 aa, Chlamydia trachomatis
PRYQL

SEQ ID NO: 1322 - protein, 5 aa, Chlamydia trachomatis
RYQLQ

SEQ ID NO: 1323 - protein, 5 aa, Chlamydia trachomatis
YQLQN

SEQ ID NO: 1324 - protein, 5 aa, Chlamydia trachomatis
QLQNM

SEQ ID NO: 1325 - protein, 5 aa, Chlamydia trachomatis
LQNMD

SEQ ID NO: 1326 - protein, 5 aa, Chlamydia trachomatis
QNMDV

SEQ ID NO: 1327 - protein, 5 aa, Chlamydia trachomatis
NMDVE

SEQ ID NO: 1328 - protein, 5 aa, Chlamydia trachomatis
MDVEA

SEQ ID NO: 1329 - protein, 5 aa, Chlamydia trachomatis
DVEAG

SEQ ID NO: 1330 - protein, 5 aa, Chlamydia trachomatis
VEAGF

SEQ ID NO: 1331 - protein, 5 aa, Chlamydia trachomatis
EAGFR

SEQ ID NO: 1332 - protein, 5 aa, Chlamydia trachomatis
AGFRE

SEQ ID NO: 1333 - protein, 5 aa, Chlamydia trachomatis
GFREA

SEQ ID NO: 1334 - protein, 5 aa, Chlamydia trachomatis
FREAV

SEQ ID NO: 1335 - protein, 5 aa, Chlamydia trachomatis
REAVY

SEQ ID NO: 1336 - protein, 5 aa, Chlamydia trachomatis
EAVYA

SEQ ID NO: 1337 - protein, 5 aa, Chlamydia trachomatis
AVYAS

SEQ ID NO: 1338 - protein, 5 aa, Chlamydia trachomatis
VYASF

SEQ ID NO: 1339 - protein, 5 aa, Chlamydia trachomatis
YASFV

SEQ ID NO: 1340 - protein, 5 aa, Chlamydia trachomatis
ASFVA

SEQ ID NO: 1341 - protein, 5 aa, Chlamydia trachomatis
SFVAG

SEQ ID NO: 1342 - protein, 5 aa, Chlamydia trachomatis
FVAGM

SEQ ID NO: 1343 - protein, 5 aa, Chlamydia trachomatis
VAGMY

SEQ ID NO: 1344 - protein, 5 aa, Chlamydia trachomatis
AGMYN

SEQ ID NO: 1345 - protein, 5 aa, Chlamydia trachomatis
GMYNY

SEQ ID NO: 1346 - protein, 5 aa, Chlamydia trachomatis
MYNYV

SEQ ID NO: 1347 - protein, 5 aa, Chlamydia trachomatis
YNYVV

SEQ ID NO: 1348 - protein, 5 aa, Chlamydia trachomatis
NYVVT

SEQ ID NO: 1349 - protein, 5 aa, Chlamydia trachomatis
YVVTQ

SEQ ID NO: 1350 - protein, 5 aa, Chlamydia trachomatis
VVTQP

SEQ ID NO: 1351 - protein, 5 aa, Chlamydia trachomatis
VTQPQ

SEQ ID NO: 1352 - protein, 5 aa, Chlamydia trachomatis
TQPQE

SEQ ID NO: 1353 - protein, 5 aa, Chlamydia trachomatis
QPQER

SEQ ID NO: 1354 - protein, 5 aa, Chlamydia trachomatis
PQERI

SEQ ID NO: 1355 - protein, 5 aa, Chlamydia trachomatis
QERIP

SEQ ID NO: 1356 - protein, 5 aa, Chlamydia trachomatis
ERIPN

SEQ ID NO: 1357 - protein, 5 aa, Chlamydia trachomatis
RIPNS

SEQ ID NO: 1358 - protein, 5 aa, Chlamydia trachomatis
IPNSQ

SEQ ID NO: 1359 - protein, 5 aa, Chlamydia trachomatis
PNSQQ

SEQ ID NO: 1360 - protein, 5 aa, Chlamydia trachomatis
NSQQV

SEQ ID NO: 1361 - protein, 5 aa, Chlamydia trachomatis
SQQVE

SEQ ID NO: 1362 - protein, 5 aa, Chlamydia trachomatis
QQVEG

SEQ ID NO: 1363 - protein, 5 aa, Chlamydia trachomatis
QVEGI

SEQ ID NO: 1364 - protein, 5 aa, Chlamydia trachomatis
VEGIL

SEQ ID NO: 1365 - protein, 5 aa, Chlamydia trachomatis
EGILR

SEQ ID NO: 1366 - protein, 5 aa, Chlamydia trachomatis
GILRD

SEQ ID NO: 1367 - protein, 5 aa, Chlamydia trachomatis
ILRDM

SEQ ID NO: 1368 - protein, 5 aa, Chlamydia trachomatis
LRDML

SEQ ID NO: 1369 - protein, 5 aa, Chlamydia trachomatis
RDMLT

SEQ ID NO: 1370 - protein, 5 aa, Chlamydia trachomatis
DMLTN

SEQ ID NO: 1371 - protein, 5 aa, Chlamydia trachomatis
MLTNG

SEQ ID NO: 1372 - protein, 5 aa, Chlamydia trachomatis
LTNGS

SEQ ID NO: 1373 - protein, 5 aa, Chlamydia trachomatis
TNGSQ

SEQ ID NO: 1374 - protein, 5 aa, Chlamydia trachomatis
NGSQT

SEQ ID NO: 1375 - protein, 5 aa, Chlamydia trachomatis
GSQTF

SEQ ID NO: 1376 - protein, 5 aa, Chlamydia trachomatis
SQTFR

SEQ ID NO: 1377 - protein, 5 aa, Chlamydia trachomatis
QTFRD

SEQ ID NO: 1378 - protein, 5 aa, Chlamydia trachomatis
TFRDL

SEQ ID NO: 1379 - protein, 5 aa, Chlamydia trachomatis
FRDLM

SEQ ID NO: 1380 - protein, 5 aa, Chlamydia trachomatis
RDLMR

SEQ ID NO: 1381 - protein, 5 aa, Chlamydia trachomatis
DLMRR

SEQ ID NO: 1382 - protein, 5 aa, Chlamydia trachomatis
LMRRW

SEQ ID NO: 1383 - protein, 5 aa, Chlamydia trachomatis
MRRWN

SEQ ID NO: 1384 - protein, 5 aa, Chlamydia trachomatis
RRWNR

SEQ ID NO: 1385 - protein, 5 aa, Chlamydia trachomatis
RWNRE

SEQ ID NO: 1386 - protein, 5 aa, Chlamydia trachomatis
WNREV

SEQ ID NO: 1387 - protein, 5 aa, Chlamydia trachomatis
NREVD

SEQ ID NO: 1388 - protein, 5 aa, Chlamydia trachomatis
REVDR

SEQ ID NO: 1389 - protein, 5 aa, Chlamydia trachomatis
EVDRE

SEQ ID NO: 1390 - protein, 5 aa, Chlamydia trachomatis
MANPS

SEQ ID NO: 1391 - protein, 5 aa, Chlamydia trachomatis
ANPST

SEQ ID NO: 1392 - protein, 5 aa, Chlamydia trachomatis
NPSTP

SEQ ID NO: 1393 - protein, 5 aa, Chlamydia trachomatis
PSTPS

SEQ ID NO: 1394 - protein, 5 aa, Chlamydia trachomatis
STPSF

SEQ ID NO: 1395 - protein, 5 aa, Chlamydia trachomatis
TPSFN

SEQ ID NO: 1396 - protein, 5 aa, Chlamydia trachomatis
PSFNH

SEQ ID NO: 1397 - protein, 5 aa, Chlamydia trachomatis
SFNHS

SEQ ID NO: 1398 - protein, 5 aa, Chlamydia trachomatis
FNHSD

SEQ ID NO: 1399 - protein, 5 aa, Chlamydia trachomatis
NHSDL

SEQ ID NO: 1400 - protein, 5 aa, Chlamydia trachomatis
HSDLS

SEQ ID NO: 1401 - protein, 5 aa, Chlamydia trachomatis
SDLSL

SEQ ID NO: 1402 - protein, 5 aa, Chlamydia trachomatis
DLSLQ

SEQ ID NO: 1403 - protein, 5 aa, Chlamydia trachomatis
LSLQG

SEQ ID NO: 1404 - protein, 5 aa, Chlamydia trachomatis
SLQGR

SEQ ID NO: 1405 - protein, 5 aa, Chlamydia trachomatis
LQGRL

SEQ ID NO: 1406 - protein, 5 aa, Chlamydia trachomatis
QGRLR

SEQ ID NO: 1407 - protein, 5 aa, Chlamydia trachomatis
GRLRA

SEQ ID NO: 1408 - protein, 5 aa, Chlamydia trachomatis
RLRAS

SEQ ID NO: 1409 - protein, 5 aa, Chlamydia trachomatis
LRASS

SEQ ID NO: 1410 - protein, 5 aa, Chlamydia trachomatis
RASSQ

SEQ ID NO: 1411 - protein, 5 aa, Chlamydia trachomatis
ASSQQ

SEQ ID NO: 1412 - protein, 5 aa, Chlamydia trachomatis
SSQQC

SEQ ID NO: 1413 - protein, 5 aa, Chlamydia trachomatis
SQQCT

SEQ ID NO: 1414 - protein, 5 aa, Chlamydia trachomatis
QQCTQ

SEQ ID NO: 1415 - protein, 5 aa, Chlamydia trachomatis
QCTQA

SEQ ID NO: 1416 - protein, 5 aa, Chlamydia trachomatis
CTQAG

SEQ ID NO: 1417 - protein, 5 aa, Chlamydia trachomatis
TQAGQ

SEQ ID NO: 1418 - protein, 5 aa, Chlamydia trachomatis
QAGQG

SEQ ID NO: 1419 - protein, 5 aa, Chlamydia trachomatis
AGQGD

SEQ ID NO: 1420 - protein, 5 aa, Chlamydia trachomatis
GQGDP

SEQ ID NO: 1421 - protein, 5 aa, Chlamydia trachomatis
QGDPQ

SEQ ID NO: 1422 - protein, 5 aa, Chlamydia trachomatis
GDPQP

SEQ ID NO: 1423 - protein, 5 aa, Chlamydia trachomatis
DPQPL

SEQ ID NO: 1424 - protein, 5 aa, Chlamydia trachomatis
PQPLS

SEQ ID NO: 1425 - protein, 5 aa, Chlamydia trachomatis
QPLSP

SEQ ID NO: 1426 - protein, 5 aa, Chlamydia trachomatis
PLSPE

SEQ ID NO: 1427 - protein, 5 aa, Chlamydia trachomatis
LSPES

SEQ ID NO: 1428 - protein, 5 aa, Chlamydia trachomatis
SPESR

SEQ ID NO: 1429 - protein, 5 aa, Chlamydia trachomatis
PESRG

SEQ ID NO: 1430 - protein, 5 aa, Chlamydia trachomatis
ESRGL

SEQ ID NO: 1431 - protein, 5 aa, Chlamydia trachomatis
SRGLT

SEQ ID NO: 1432 - protein, 5 aa, Chlamydia trachomatis
RGLTS

SEQ ID NO: 1433 - protein, 5 aa, Chlamydia trachomatis
GLTSN

SEQ ID NO: 1434 - protein, 5 aa, Chlamydia trachomatis
LTSNF

SEQ ID NO: 1435 - protein, 5 aa, Chlamydia trachomatis
TSNFS

SEQ ID NO: 1436 - protein, 5 aa, Chlamydia trachomatis
SNFST

SEQ ID NO: 1437 - protein, 5 aa, Chlamydia trachomatis
NFSTR

SEQ ID NO: 1438 - protein, 5 aa, Chlamydia trachomatis
FSTRR

SEQ ID NO: 1439 - protein, 5 aa, Chlamydia trachomatis
STRRD

SEQ ID NO: 1440 - protein, 5 aa, Chlamydia trachomatis
TRRDL

SEQ ID NO: 1441 - protein, 5 aa, Chlamydia trachomatis
RRDLI

SEQ ID NO: 1442 - protein, 5 aa, Chlamydia trachomatis
RDLID

SEQ ID NO: 1443 - protein, 5 aa, Chlamydia trachomatis
DLIDV

SEQ ID NO: 1444 - protein, 5 aa, Chlamydia trachomatis
LIDVV

SEQ ID NO: 1445 - protein, 5 aa, Chlamydia trachomatis
IDVVE

SEQ ID NO: 1446 - protein, 5 aa, Chlamydia trachomatis
DVVEE

SEQ ID NO: 1447 - protein, 5 aa, Chlamydia trachomatis
VVEES

SEQ ID NO: 1448 - protein, 5 aa, Chlamydia trachomatis
VEESI

SEQ ID NO: 1449 - protein, 5 aa, Chlamydia trachomatis
EESIE

SEQ ID NO: 1450 - protein, 5 aa, Chlamydia trachomatis
ESIET

SEQ ID NO: 1451 - protein, 5 aa, Chlamydia trachomatis
SIETA

SEQ ID NO: 1452 - protein, 5 aa, Chlamydia trachomatis
IETAK

SEQ ID NO: 1453 - protein, 5 aa, Chlamydia trachomatis
ETAKG

SEQ ID NO: 1454 - protein, 5 aa, Chlamydia trachomatis
TAKGS

SEQ ID NO: 1455 - protein, 5 aa, Chlamydia trachomatis
AKGSE

SEQ ID NO: 1456 - protein, 5 aa, Chlamydia trachomatis
KGSEL

SEQ ID NO: 1457 - protein, 5 aa, Chlamydia trachomatis
GSELK

SEQ ID NO: 1458 - protein, 5 aa, Chlamydia trachomatis
SELKK

SEQ ID NO: 1459 - protein, 5 aa, Chlamydia trachomatis
ELKKL

SEQ ID NO: 1460 - protein, 5 aa, Chlamydia trachomatis
LKKLR

SEQ ID NO: 1461 - protein, 5 aa, Chlamydia trachomatis
KKLRI

SEQ ID NO: 1462 - protein, 5 aa, Chlamydia trachomatis
KLRIY

SEQ ID NO: 1463 - protein, 5 aa, Chlamydia trachomatis
LRIYE

SEQ ID NO: 1464 - protein, 5 aa, Chlamydia trachomatis
RIYEI

SEQ ID NO: 1465 - protein, 5 aa, Chlamydia trachomatis
IYEIA

SEQ ID NO: 1466 - protein, 5 aa, Chlamydia trachomatis
YEIAL

SEQ ID NO: 1467 - protein, 5 aa, Chlamydia trachomatis
EIALK

SEQ ID NO: 1468 - protein, 5 aa, Chlamydia trachomatis
IALKI

SEQ ID NO: 1469 - protein, 5 aa, Chlamydia trachomatis
ALKIL

SEQ ID NO: 1470 - protein, 5 aa, Chlamydia trachomatis
LKILT

SEQ ID NO: 1471 - protein, 5 aa, Chlamydia trachomatis
KILTI

SEQ ID NO: 1472 - protein, 5 aa, Chlamydia trachomatis
ILTII

SEQ ID NO: 1473 - protein, 5 aa, Chlamydia trachomatis
LTIIG

SEQ ID NO: 1474 - protein, 5 aa, Chlamydia trachomatis
TIIGA

SEQ ID NO: 1475 - protein, 5 aa, Chlamydia trachomatis
IIGAA

SEQ ID NO: 1476 - protein, 5 aa, Chlamydia trachomatis
IGAAI

SEQ ID NO: 1477 - protein, 5 aa, Chlamydia trachomatis
GAAIL

SEQ ID NO: 1478 - protein, 5 aa, Chlamydia trachomatis
AAILF

SEQ ID NO: 1479 - protein, 5 aa, Chlamydia trachomatis
AILFA

SEQ ID NO: 1480 - protein, 5 aa, Chlamydia trachomatis
ILFAV

SEQ ID NO: 1481 - protein, 5 aa, Chlamydia trachomatis
LFAVP

SEQ ID NO: 1482 - protein, 5 aa, Chlamydia trachomatis
FAVPL

SEQ ID NO: 1483 - protein, 5 aa, Chlamydia trachomatis
AVPLC

SEQ ID NO: 1484 - protein, 5 aa, Chlamydia trachomatis
VPLCM

SEQ ID NO: 1485 - protein, 5 aa, Chlamydia trachomatis
PLCML

SEQ ID NO: 1486 - protein, 5 aa, Chlamydia trachomatis
LCMLL

SEQ ID NO: 1487 - protein, 5 aa, Chlamydia trachomatis
CMLLG

SEQ ID NO: 1488 - protein, 5 aa, Chlamydia trachomatis
MLLGV

SEQ ID NO: 1489 - protein, 5 aa, Chlamydia trachomatis
LLGVP

SEQ ID NO: 1490 - protein, 5 aa, Chlamydia trachomatis
LGVPL

SEQ ID NO: 1491 - protein, 5 aa, Chlamydia trachomatis
GVPLW

SEQ ID NO: 1492 - protein, 5 aa, Chlamydia trachomatis
VPLWI

SEQ ID NO: 1493 - protein, 5 aa, Chlamydia trachomatis
PLWIP

SEQ ID NO: 1494 - protein, 5 aa, Chlamydia trachomatis
LWIPI

SEQ ID NO: 1495 - protein, 5 aa, Chlamydia trachomatis
WIPIV

SEQ ID NO: 1496 - protein, 5 aa, Chlamydia trachomatis
IPIVT

SEQ ID NO: 1497 - protein, 5 aa, Chlamydia trachomatis
PIVTC

SEQ ID NO: 1498 - protein, 5 aa, Chlamydia trachomatis
IVTCI

SEQ ID NO: 1499 - protein, 5 aa, Chlamydia trachomatis
VTCIG

SEQ ID NO: 1500 - protein, 5 aa, Chlamydia trachomatis
TCIGV

SEQ ID NO: 1501 - protein, 5 aa, Chlamydia trachomatis
CIGVG

SEQ ID NO: 1502 - protein, 5 aa, Chlamydia trachomatis
IGVGI

SEQ ID NO: 1503 - protein, 5 aa, Chlamydia trachomatis
GVGIA

SEQ ID NO: 1504 - protein, 5 aa, Chlamydia trachomatis
VGIAF

SEQ ID NO: 1505 - protein, 5 aa, Chlamydia trachomatis
GIAFS

SEQ ID NO: 1506 - protein, 5 aa, Chlamydia trachomatis
IAFSI

SEQ ID NO: 1507 - protein, 5 aa, Chlamydia trachomatis
AFSIA

SEQ ID NO: 1508 - protein, 5 aa, Chlamydia trachomatis
FSIAK

SEQ ID NO: 1509 - protein, 5 aa, Chlamydia trachomatis
SIAKG

SEQ ID NO: 1510 - protein, 5 aa, Chlamydia trachomatis
IAKGC

SEQ ID NO: 1511 - protein, 5 aa, Chlamydia trachomatis
AKGCL

SEQ ID NO: 1512 - protein, 5 aa, Chlamydia trachomatis
KGCLQ

SEQ ID NO: 1513 - protein, 5 aa, Chlamydia trachomatis
GCLQK

SEQ ID NO: 1514 - protein, 5 aa, Chlamydia trachomatis
CLQKR

SEQ ID NO: 1515 - protein, 5 aa, Chlamydia trachomatis
LQKRC

SEQ ID NO: 1516 - protein, 5 aa, Chlamydia trachomatis
QKRCQ

SEQ ID NO: 1517 - protein, 5 aa, Chlamydia trachomatis
KRCQQ

SEQ ID NO: 1518 - protein, 5 aa, Chlamydia trachomatis
RCQQI

SEQ ID NO: 1519 - protein, 5 aa, Chlamydia trachomatis
CQQIR

SEQ ID NO: 1520 - protein, 5 aa, Chlamydia trachomatis
QQIRE

SEQ ID NO: 1521 - protein, 5 aa, Chlamydia trachomatis
QIREE

SEQ ID NO: 1522 - protein, 5 aa, Chlamydia trachomatis
IREEY

SEQ ID NO: 1523 - protein, 5 aa, Chlamydia trachomatis
REEYR

SEQ ID NO: 1524 - protein, 5 aa, Chlamydia trachomatis
EEYRA

SEQ ID NO: 1525 - protein, 5 aa, Chlamydia trachomatis
EYRAL

SEQ ID NO: 1526 - protein, 5 aa, Chlamydia trachomatis
YRALH

SEQ ID NO: 1527 - protein, 5 aa, Chlamydia trachomatis
RALHL

SEQ ID NO: 1528 - protein, 5 aa, Chlamydia trachomatis
ALHLY

SEQ ID NO: 1529 - protein, 5 aa, Chlamydia trachomatis
LHLYH

SEQ ID NO: 1530 - protein, 5 aa, Chlamydia trachomatis
HLYHR

SEQ ID NO: 1531 - protein, 5 aa, Chlamydia trachomatis
LYHRY

SEQ ID NO: 1532 - protein, 5 aa, Chlamydia trachomatis
YHRYL

SEQ ID NO: 1533 - protein, 5 aa, Chlamydia trachomatis
HRYLL

SEQ ID NO: 1534 - protein, 5 aa, Chlamydia trachomatis
RYLLS

SEQ ID NO: 1535 - protein, 5 aa, Chlamydia trachomatis
YLLSN

SEQ ID NO: 1536 - protein, 5 aa, Chlamydia trachomatis
LLSNK

SEQ ID NO: 1537 - protein, 5 aa, Chlamydia trachomatis
LSNKD

SEQ ID NO: 1538 - protein, 5 aa, Chlamydia trachomatis
SNKDS

SEQ ID NO: 1539 - protein, 5 aa, Chlamydia trachomatis
NKDSI

SEQ ID NO: 1540 - protein, 5 aa, Chlamydia trachomatis
KDSID

SEQ ID NO: 1541 - protein, 5 aa, Chlamydia trachomatis
DSIDG

SEQ ID NO: 1542 - protein, 5 aa, Chlamydia trachomatis
SIDGT

SEQ ID NO: 1543 - protein, 5 aa, Chlamydia trachomatis
IDGTL

SEQ ID NO: 1544 - protein, 5 aa, Chlamydia trachomatis
DGTLL

SEQ ID NO: 1545 - protein, 5 aa, Chlamydia trachomatis
GTLLS

SEQ ID NO: 1546 - protein, 5 aa, Chlamydia trachomatis
TLLSR

SEQ ID NO: 1547 - protein, 5 aa, Chlamydia trachomatis
LLSRF

SEQ ID NO: 1548 - protein, 5 aa, Chlamydia trachomatis
LSRFD

SEQ ID NO: 1549 - protein, 5 aa, Chlamydia trachomatis
SRFDI

SEQ ID NO: 1550 - protein, 5 aa, Chlamydia trachomatis
RFDIR

SEQ ID NO: 1551 - protein, 5 aa, Chlamydia trachomatis
FDIRF

SEQ ID NO: 1552 - protein, 5 aa, Chlamydia trachomatis
DIRFR

SEQ ID NO: 1553 - protein, 5 aa, Chlamydia trachomatis
IRFRK

SEQ ID NO: 1554 - protein, 5 aa, Chlamydia trachomatis
RFRKA

SEQ ID NO: 1555 - protein, 5 aa, Chlamydia trachomatis
FRKAE

SEQ ID NO: 1556 - protein, 5 aa, Chlamydia trachomatis
RKAEE

SEQ ID NO: 1557 - protein, 5 aa, Chlamydia trachomatis
KAEEK

SEQ ID NO: 1558 - protein, 5 aa, Chlamydia trachomatis
AEEKL

SEQ ID NO: 1559 - protein, 5 aa, Chlamydia trachomatis
EEKLH

SEQ ID NO: 1560 - protein, 5 aa, Chlamydia trachomatis
EKLHG

SEQ ID NO: 1561 - protein, 5 aa, Chlamydia trachomatis
KLHGL

SEQ ID NO: 1562 - protein, 5 aa, Chlamydia trachomatis
LHGLD

SEQ ID NO: 1563 - protein, 5 aa, Chlamydia trachomatis
HGLDL

SEQ ID NO: 1564 - protein, 5 aa, Chlamydia trachomatis
GLDLD

SEQ ID NO: 1565 - protein, 5 aa, Chlamydia trachomatis
LDLDK

SEQ ID NO: 1566 - protein, 5 aa, Chlamydia trachomatis
DLDKR

SEQ ID NO: 1567 - protein, 5 aa, Chlamydia trachomatis
LDKRE

SEQ ID NO: 1568 - protein, 5 aa, Chlamydia trachomatis
DKREA

SEQ ID NO: 1569 - protein, 5 aa, Chlamydia trachomatis
KREAN

SEQ ID NO: 1570 - protein, 5 aa, Chlamydia trachomatis
REANH

SEQ ID NO: 1571 - protein, 5 aa, Chlamydia trachomatis
EANHP

SEQ ID NO: 1572 - protein, 5 aa, Chlamydia trachomatis
ANHPL

SEQ ID NO: 1573 - protein, 5 aa, Chlamydia trachomatis
NHPLE

SEQ ID NO: 1574 - protein, 5 aa, Chlamydia trachomatis
HPLEA

SEQ ID NO: 1575 - protein, 5 aa, Chlamydia trachomatis
PLEAD

SEQ ID NO: 1576 - protein, 5 aa, Chlamydia trachomatis
LEADK

SEQ ID NO: 1577 - protein, 5 aa, Chlamydia trachomatis
EADKR

SEQ ID NO: 1578 - protein, 5 aa, Chlamydia trachomatis
ADKRY

SEQ ID NO: 1579 - protein, 5 aa, Chlamydia trachomatis
DKRYD

SEQ ID NO: 1580 - protein, 5 aa, Chlamydia trachomatis
KRYDF

SEQ ID NO: 1581 - protein, 5 aa, Chlamydia trachomatis
RYDFA

SEQ ID NO: 1582 - protein, 5 aa, Chlamydia trachomatis
YDFAG

SEQ ID NO: 1583 - protein, 5 aa, Chlamydia trachomatis
DFAGL

SEQ ID NO: 1584 - protein, 5 aa, Chlamydia trachomatis
FAGLA

SEQ ID NO: 1585 - protein, 5 aa, Chlamydia trachomatis
AGLAH

SEQ ID NO: 1586 - protein, 5 aa, Chlamydia trachomatis
GLAHQ

SEQ ID NO: 1587 - protein, 5 aa, Chlamydia trachomatis
LAHQR

SEQ ID NO: 1588 - protein, 5 aa, Chlamydia trachomatis
AHQRY

SEQ ID NO: 1589 - protein, 5 aa, Chlamydia trachomatis
HQRYQ

SEQ ID NO: 1590 - protein, 5 aa, Chlamydia trachomatis
QRYQV

SEQ ID NO: 1591 - protein, 5 aa, Chlamydia trachomatis
RYQVD

SEQ ID NO: 1592 - protein, 5 aa, Chlamydia trachomatis
YQVDA

SEQ ID NO: 1593 - protein, 5 aa, Chlamydia trachomatis
QVDAA

SEQ ID NO: 1594 - protein, 5 aa, Chlamydia trachomatis
VDAAL

SEQ ID NO: 1595 - protein, 5 aa, Chlamydia trachomatis
DAALG

SEQ ID NO: 1596 - protein, 5 aa, Chlamydia trachomatis
AALGI

SEQ ID NO: 1597 - protein, 5 aa, Chlamydia trachomatis
ALGIS

SEQ ID NO: 1598 - protein, 5 aa, Chlamydia trachomatis
LGISS

SEQ ID NO: 1599 - protein, 5 aa, Chlamydia trachomatis
GISSS

SEQ ID NO: 1600 - protein, 5 aa, Chlamydia trachomatis
ISSSQ

SEQ ID NO: 1601 - protein, 5 aa, Chlamydia trachomatis
SSSQD

SEQ ID NO: 1602 - protein, 5 aa, Chlamydia trachomatis
SSQDA

SEQ ID NO: 1603 - protein, 5 aa, Chlamydia trachomatis
SQDAF

SEQ ID NO: 1604 - protein, 5 aa, Chlamydia trachomatis
QDAFW

SEQ ID NO: 1605 - protein, 5 aa, Chlamydia trachomatis
DAFWR

SEQ ID NO: 1606 - protein, 5 aa, Chlamydia trachomatis
AFWRG

SEQ ID NO: 1607 - protein, 5 aa, Chlamydia trachomatis
FWRGV

SEQ ID NO: 1608 - protein, 5 aa, Chlamydia trachomatis
WRGVA

SEQ ID NO: 1609 - protein, 5 aa, Chlamydia trachomatis
RGVAQ

SEQ ID NO: 1610 - protein, 5 aa, Chlamydia trachomatis
GVAQQ

SEQ ID NO: 1611 - protein, 5 aa, Chlamydia trachomatis
VAQQV

SEQ ID NO: 1612 - protein, 5 aa, Chlamydia trachomatis
AQQVK

SEQ ID NO: 1613 - protein, 5 aa, Chlamydia trachomatis
QQVKS

SEQ ID NO: 1614 - protein, 5 aa, Chlamydia trachomatis
QVKSV

SEQ ID NO: 1615 - protein, 5 aa, Chlamydia trachomatis
VKSVK

SEQ ID NO: 1616 - protein, 5 aa, Chlamydia trachomatis
KSVKD

SEQ ID NO: 1617 - protein, 5 aa, Chlamydia trachomatis
SVKDD

SEQ ID NO: 1618 - protein, 5 aa, Chlamydia trachomatis
VKDDV

SEQ ID NO: 1619 - protein, 5 aa, Chlamydia trachomatis
KDDVV

SEQ ID NO: 1620 - protein, 5 aa, Chlamydia trachomatis
DDVVL

SEQ ID NO: 1621 - protein, 5 aa, Chlamydia trachomatis
DVVLG

SEQ ID NO: 1622 - protein, 5 aa, Chlamydia trachomatis
VVLGD

SEQ ID NO: 1623 - protein, 5 aa, Chlamydia trachomatis
VLGDK

SEQ ID NO: 1624 - protein, 5 aa, Chlamydia trachomatis
LGDKA

SEQ ID NO: 1625 - protein, 5 aa, Chlamydia trachomatis
GDKAS

SEQ ID NO: 1626 - protein, 5 aa, Chlamydia trachomatis
DKAST

SEQ ID NO: 1627 - protein, 5 aa, Chlamydia trachomatis
KASTD

SEQ ID NO: 1628 - protein, 5 aa, Chlamydia trachomatis
ASTDL

SEQ ID NO: 1629 - protein, 5 aa, Chlamydia trachomatis
STDLY

SEQ ID NO: 1630 - protein, 5 aa, Chlamydia trachomatis
TDLYP

SEQ ID NO: 1631 - protein, 5 aa, Chlamydia trachomatis
DLYPI

SEQ ID NO: 1632 - protein, 5 aa, Chlamydia trachomatis
LYPIA

SEQ ID NO: 1633 - protein, 5 aa, Chlamydia trachomatis
YPIAQ

SEQ ID NO: 1634 - protein, 5 aa, Chlamydia trachomatis
PIAQQ

SEQ ID NO: 1635 - protein, 5 aa, Chlamydia trachomatis
IAQQA

SEQ ID NO: 1636 - protein, 5 aa, Chlamydia trachomatis
AQQAL

SEQ ID NO: 1637 - protein, 5 aa, Chlamydia trachomatis
QQALQ

SEQ ID NO: 1638 - protein, 5 aa, Chlamydia trachomatis
QALQA

SEQ ID NO: 1639 - protein, 5 aa, Chlamydia trachomatis
ALQAA

SEQ ID NO: 1640 - protein, 5 aa, Chlamydia trachomatis
LQAAG

SEQ ID NO: 1641 - protein, 5 aa, Chlamydia trachomatis
QAAGV

SEQ ID NO: 1642 - protein, 5 aa, Chlamydia trachomatis
AAGVG

SEQ ID NO: 1643 - protein, 5 aa, Chlamydia trachomatis
AGVGF

SEQ ID NO: 1644 - protein, 5 aa, Chlamydia trachomatis
GVGFS

SEQ ID NO: 1645 - protein, 5 aa, Chlamydia trachomatis
VGFSG

SEQ ID NO: 1646 - protein, 5 aa, Chlamydia trachomatis
GFSGA

SEQ ID NO: 1647 - protein, 5 aa, Chlamydia trachomatis
FSGAA

SEQ ID NO: 1648 - protein, 5 aa, Chlamydia trachomatis
SGAAG

SEQ ID NO: 1649 - protein, 5 aa, Chlamydia trachomatis
GAAGK

SEQ ID NO: 1650 - protein, 5 aa, Chlamydia trachomatis
AAGKE

SEQ ID NO: 1651 - protein, 5 aa, Chlamydia trachomatis
AGKES

SEQ ID NO: 1652 - protein, 5 aa, Chlamydia trachomatis
GKESL

SEQ ID NO: 1653 - protein, 5 aa, Chlamydia trachomatis
KESLL

SEQ ID NO: 1654 - protein, 5 aa, Chlamydia trachomatis
ESLLD

SEQ ID NO: 1655 - protein, 5 aa, Chlamydia trachomatis
SLLDL

SEQ ID NO: 1656 - protein, 5 aa, Chlamydia trachomatis
LLDLA

SEQ ID NO: 1657 - protein, 5 aa, Chlamydia trachomatis
LDLAK

SEQ ID NO: 1658 - protein, 5 aa, Chlamydia trachomatis
DLAKS

SEQ ID NO: 1659 - protein, 5 aa, Chlamydia trachomatis
LAKSL

SEQ ID NO: 1660 - protein, 5 aa, Chlamydia trachomatis
AKSLS

SEQ ID NO: 1661 - protein, 5 aa, Chlamydia trachomatis
KSLSS

SEQ ID NO: 1662 - protein, 5 aa, Chlamydia trachomatis
SLSSL

SEQ ID NO: 1663 - protein, 5 aa, Chlamydia trachomatis
LSSLF

SEQ ID NO: 1664 - protein, 5 aa, Chlamydia trachomatis
SSLFA

SEQ ID NO: 1665 - protein, 5 aa, Chlamydia trachomatis
SLFAW

SEQ ID NO: 1666 - protein, 5 aa, Chlamydia trachomatis
LFAWG

SEQ ID NO: 1667 - protein, 5 aa, Chlamydia trachomatis
FAWGS

SEQ ID NO: 1668 - protein, 5 aa, Chlamydia trachomatis
AWGSQ

SEQ ID NO: 1669 - protein, 5 aa, Chlamydia trachomatis
WGSQV

SEQ ID NO: 1670 - protein, 5 aa, Chlamydia trachomatis
GSQVG

SEQ ID NO: 1671 - protein, 5 aa, Chlamydia trachomatis
SQVGK

SEQ ID NO: 1672 - protein, 5 aa, Chlamydia trachomatis
QVGKD

SEQ ID NO: 1673 - protein, 5 aa, Chlamydia trachomatis
VGKDS

SEQ ID NO: 1674 - protein, 5 aa, Chlamydia trachomatis
GKDSH

SEQ ID NO: 1675 - protein, 5 aa, Chlamydia trachomatis
KDSHE

SEQ ID NO: 1676 - protein, 5 aa, Chlamydia trachomatis
DSHEA

SEQ ID NO: 1677 - protein, 5 aa, Chlamydia trachomatis
SHEAL

SEQ ID NO: 1678 - protein, 5 aa, Chlamydia trachomatis
HEALQ

SEQ ID NO: 1679 - protein, 5 aa, Chlamydia trachomatis
EALQQ

SEQ ID NO: 1680 - protein, 5 aa, Chlamydia trachomatis
ALQQY

SEQ ID NO: 1681 - protein, 5 aa, Chlamydia trachomatis
LQQYQ

SEQ ID NO: 1682 - protein, 5 aa, Chlamydia trachomatis
QQYQM

SEQ ID NO: 1683 - protein, 5 aa, Chlamydia trachomatis
QYQMR

SEQ ID NO: 1684 - protein, 5 aa, Chlamydia trachomatis
YQMRF

SEQ ID NO: 1685 - protein, 5 aa, Chlamydia trachomatis
QMRFL

SEQ ID NO: 1686 - protein, 5 aa, Chlamydia trachomatis
MRFLS

SEQ ID NO: 1687 - protein, 5 aa, Chlamydia trachomatis
RFLSS

SEQ ID NO: 1688 - protein, 5 aa, Chlamydia trachomatis
FLSSP

SEQ ID NO: 1689 - protein, 5 aa, Chlamydia trachomatis
LSSPI

SEQ ID NO: 1690 - protein, 5 aa, Chlamydia trachomatis
SSPIL

SEQ ID NO: 1691 - protein, 5 aa, Chlamydia trachomatis
SPILA

SEQ ID NO: 1692 - protein, 5 aa, Chlamydia trachomatis
PILAT

SEQ ID NO: 1693 - protein, 5 aa, Chlamydia trachomatis
ILATW

SEQ ID NO: 1694 - protein, 5 aa, Chlamydia trachomatis
LATWC

SEQ ID NO: 1695 - protein, 5 aa, Chlamydia trachomatis
ATWCG

SEQ ID NO: 1696 - protein, 5 aa, Chlamydia trachomatis
TWCGA

SEQ ID NO: 1697 - protein, 5 aa, Chlamydia trachomatis
WCGAG

SEQ ID NO: 1698 - protein, 5 aa, Chlamydia trachomatis
CGAGF

SEQ ID NO: 1699 - protein, 5 aa, Chlamydia trachomatis
GAGFS

SEQ ID NO: 1700 - protein, 5 aa, Chlamydia trachomatis
AGFSA

SEQ ID NO: 1701 - protein, 5 aa, Chlamydia trachomatis
GFSAS

SEQ ID NO: 1702 - protein, 5 aa, Chlamydia trachomatis
FSASA

SEQ ID NO: 1703 - protein, 5 aa, Chlamydia trachomatis
SASAQ

SEQ ID NO: 1704 - protein, 5 aa, Chlamydia trachomatis
ASAQD

SEQ ID NO: 1705 - protein, 5 aa, Chlamydia trachomatis
SAQDF

SEQ ID NO: 1706 - protein, 5 aa, Chlamydia trachomatis
AQDFV

SEQ ID NO: 1707 - protein, 5 aa, Chlamydia trachomatis
QDFVL

SEQ ID NO: 1708 - protein, 5 aa, Chlamydia trachomatis
DFVLK

SEQ ID NO: 1709 - protein, 5 aa, Chlamydia trachomatis
FVLKG

SEQ ID NO: 1710 - protein, 5 aa, Chlamydia trachomatis
VLKGE

SEQ ID NO: 1711 - protein, 5 aa, Chlamydia trachomatis
LKGEN

SEQ ID NO: 1712 - protein, 5 aa, Chlamydia trachomatis
KGENI

SEQ ID NO: 1713 - protein, 5 aa, Chlamydia trachomatis
GENIL

SEQ ID NO: 1714 - protein, 5 aa, Chlamydia trachomatis
ENILD

SEQ ID NO: 1715 - protein, 5 aa, Chlamydia trachomatis
NILDI

SEQ ID NO: 1716 - protein, 5 aa, Chlamydia trachomatis
ILDIA

SEQ ID NO: 1717 - protein, 5 aa, Chlamydia trachomatis
LDIAS

SEQ ID NO: 1718 - protein, 5 aa, Chlamydia trachomatis
DIASE

SEQ ID NO: 1719 - protein, 5 aa, Chlamydia trachomatis
IASEN

SEQ ID NO: 1720 - protein, 5 aa, Chlamydia trachomatis
ASENH

SEQ ID NO: 1721 - protein, 5 aa, Chlamydia trachomatis
SENHT

SEQ ID NO: 1722 - protein, 5 aa, Chlamydia trachomatis
ENHTK

SEQ ID NO: 1723 - protein, 5 aa, Chlamydia trachomatis
NHTKM

SEQ ID NO: 1724 - protein, 5 aa, Chlamydia trachomatis
HTKMQ

SEQ ID NO: 1725 - protein, 5 aa, Chlamydia trachomatis
TKMQN

SEQ ID NO: 1726 - protein, 5 aa, Chlamydia trachomatis
KMQNA

SEQ ID NO: 1727 - protein, 5 aa, Chlamydia trachomatis
MQNAI

SEQ ID NO: 1728 - protein, 5 aa, Chlamydia trachomatis
QNAIK

SEQ ID NO: 1729 - protein, 5 aa, Chlamydia trachomatis
NAIKR

SEQ ID NO: 1730 - protein, 5 aa, Chlamydia trachomatis
AIKRV

SEQ ID NO: 1731 - protein, 5 aa, Chlamydia trachomatis
IKRVQ

SEQ ID NO: 1732 - protein, 5 aa, Chlamydia trachomatis
KRVQL

SEQ ID NO: 1733 - protein, 5 aa, Chlamydia trachomatis
RVQLV

SEQ ID NO: 1734 - protein, 5 aa, Chlamydia trachomatis
VQLVS

SEQ ID NO: 1735 - protein, 5 aa, Chlamydia trachomatis
QLVSV

SEQ ID NO: 1736 - protein, 5 aa, Chlamydia trachomatis
LVSVL

SEQ ID NO: 1737 - protein, 5 aa, Chlamydia trachomatis
VSVLG

SEQ ID NO: 1738 - protein, 5 aa, Chlamydia trachomatis
SVLGK

SEQ ID NO: 1739 - protein, 5 aa, Chlamydia trachomatis
VLGKM

SEQ ID NO: 1740 - protein, 5 aa, Chlamydia trachomatis
LGKMR

SEQ ID NO: 1741 - protein, 5 aa, Chlamydia trachomatis
GKMRN

SEQ ID NO: 1742 - protein, 5 aa, Chlamydia trachomatis
KMRNW

SEQ ID NO: 1743 - protein, 5 aa, Chlamydia trachomatis
MRNWK

SEQ ID NO: 1744 - protein, 5 aa, Chlamydia trachomatis
RNWKE

SEQ ID NO: 1745 - protein, 5 aa, Chlamydia trachomatis
NWKEK

SEQ ID NO: 1746 - protein, 5 aa, Chlamydia trachomatis
WKEKI

SEQ ID NO: 1747 - protein, 5 aa, Chlamydia trachomatis
KEKID

SEQ ID NO: 1748 - protein, 5 aa, Chlamydia trachomatis
EKIDT

SEQ ID NO: 1749 - protein, 5 aa, Chlamydia trachomatis
KIDTL

SEQ ID NO: 1750 - protein, 5 aa, Chlamydia trachomatis
IDTLI

SEQ ID NO: 1751 - protein, 5 aa, Chlamydia trachomatis
DTLIQ

SEQ ID NO: 1752 - protein, 5 aa, Chlamydia trachomatis
TLIQN

SEQ ID NO: 1753 - protein, 5 aa, Chlamydia trachomatis
LIQNK

SEQ ID NO: 1754 - protein, 5 aa, Chlamydia trachomatis
IQNKN

SEQ ID NO: 1755 - protein, 5 aa, Chlamydia trachomatis
QNKNL

SEQ ID NO: 1756 - protein, 5 aa, Chlamydia trachomatis
NKNLD

SEQ ID NO: 1757 - protein, 5 aa, Chlamydia trachomatis
KNLDQ

SEQ ID NO: 1758 - protein, 5 aa, Chlamydia trachomatis
NLDQD

SEQ ID NO: 1759 - protein, 5 aa, Chlamydia trachomatis
LDQDS

SEQ ID NO: 1760 - protein, 5 aa, Chlamydia trachomatis
DQDSL

SEQ ID NO: 1761 - protein, 5 aa, Chlamydia trachomatis
QDSLR

SEQ ID NO: 1762 - protein, 5 aa, Chlamydia trachomatis
DSLRK

SEQ ID NO: 1763 - protein, 5 aa, Chlamydia trachomatis
SLRKL

SEQ ID NO: 1764 - protein, 5 aa, Chlamydia trachomatis
LRKLY

SEQ ID NO: 1765 - protein, 5 aa, Chlamydia trachomatis
RKLYQ

SEQ ID NO: 1766 - protein, 5 aa, Chlamydia trachomatis
KLYQD

SEQ ID NO: 1767 - protein, 5 aa, Chlamydia trachomatis
LYQDI

SEQ ID NO: 1768 - protein, 5 aa, Chlamydia trachomatis
YQDIE

SEQ ID NO: 1769 - protein, 5 aa, Chlamydia trachomatis
QDIEK

SEQ ID NO: 1770 - protein, 5 aa, Chlamydia trachomatis
DIEKA

SEQ ID NO: 1771 - protein, 5 aa, Chlamydia trachomatis
IEKAM

SEQ ID NO: 1772 - protein, 5 aa, Chlamydia trachomatis
EKAMH

SEQ ID NO: 1773 - protein, 5 aa, Chlamydia trachomatis
KAMHK

SEQ ID NO: 1774 - protein, 5 aa, Chlamydia trachomatis
AMHKV

SEQ ID NO: 1775 - protein, 5 aa, Chlamydia trachomatis
MHKVC

SEQ ID NO: 1776 - protein, 5 aa, Chlamydia trachomatis
HKVCI

SEQ ID NO: 1777 - protein, 5 aa, Chlamydia trachomatis
KVCIE

SEQ ID NO: 1778 - protein, 5 aa, Chlamydia trachomatis
VCIED

SEQ ID NO: 1779 - protein, 5 aa, Chlamydia trachomatis
CIEDG

SEQ ID NO: 1780 - protein, 5 aa, Chlamydia trachomatis
IEDGV

SEQ ID NO: 1781 - protein, 5 aa, Chlamydia trachomatis
EDGVS

SEQ ID NO: 1782 - protein, 5 aa, Chlamydia trachomatis
DGVST

SEQ ID NO: 1783 - protein, 5 aa, Chlamydia trachomatis
GVSTS

SEQ ID NO: 1784 - protein, 5 aa, Chlamydia trachomatis
VSTSI

SEQ ID NO: 1785 - protein, 5 aa, Chlamydia trachomatis
STSIQ

SEQ ID NO: 1786 - protein, 5 aa, Chlamydia trachomatis
TSIQT

SEQ ID NO: 1787 - protein, 5 aa, Chlamydia trachomatis
SIQTQ

SEQ ID NO: 1788 - protein, 5 aa, Chlamydia trachomatis
IQTQV

SEQ ID NO: 1789 - protein, 5 aa, Chlamydia trachomatis
QTQVR

SEQ ID NO: 1790 - protein, 5 aa, Chlamydia trachomatis
TQVRK

SEQ ID NO: 1791 - protein, 5 aa, Chlamydia trachomatis
QVRKV

SEQ ID NO: 1792 - protein, 5 aa, Chlamydia trachomatis
VRKVT

SEQ ID NO: 1793 - protein, 5 aa, Chlamydia trachomatis
RKVTQ

SEQ ID NO: 1794 - protein, 5 aa, Chlamydia trachomatis
KVTQK

SEQ ID NO: 1795 - protein, 5 aa, Chlamydia trachomatis
VTQKY

SEQ ID NO: 1796 - protein, 5 aa, Chlamydia trachomatis
TQKYL

SEQ ID NO: 1797 - protein, 5 aa, Chlamydia trachomatis
QKYLR

SEQ ID NO: 1798 - protein, 5 aa, Chlamydia trachomatis
KYLRQ

SEQ ID NO: 1799 - protein, 5 aa, Chlamydia trachomatis
YLRQD

SEQ ID NO: 1800 - protein, 5 aa, Chlamydia trachomatis
LRQDL

SEQ ID NO: 1801 - protein, 5 aa, Chlamydia trachomatis
RQDLQ

SEQ ID NO: 1802 - protein, 5 aa, Chlamydia trachomatis
QDLQE

SEQ ID NO: 1803 - protein, 5 aa, Chlamydia trachomatis
DLQEL

SEQ ID NO: 1804 - protein, 5 aa, Chlamydia trachomatis
LQELL

SEQ ID NO: 1805 - protein, 5 aa, Chlamydia trachomatis
QELLN

SEQ ID NO: 1806 - protein, 5 aa, Chlamydia trachomatis
ELLNK

SEQ ID NO: 1807 - protein, 5 aa, Chlamydia trachomatis
LLNKK

SEQ ID NO: 1808 - protein, 5 aa, Chlamydia trachomatis
LNKKA

SEQ ID NO: 1809 - protein, 5 aa, Chlamydia trachomatis
NKKAP

SEQ ID NO: 1810 - protein, 5 aa, Chlamydia trachomatis
KKAPL

SEQ ID NO: 1811 - protein, 5 aa, Chlamydia trachomatis
KAPLN

SEQ ID NO: 1812 - protein, 5 aa, Chlamydia trachomatis
APLNE

SEQ ID NO: 1813 - protein, 5 aa, Chlamydia trachomatis
PLNES

SEQ ID NO: 1814 - protein, 5 aa, Chlamydia trachomatis
LNESD

SEQ ID NO: 1815 - protein, 5 aa, Chlamydia trachomatis
NESDL

SEQ ID NO: 1816 - protein, 5 aa, Chlamydia trachomatis
ESDLS

SEQ ID NO: 1817 - protein, 5 aa, Chlamydia trachomatis
SDLSK

SEQ ID NO: 1818 - protein, 5 aa, Chlamydia trachomatis
DLSKM

SEQ ID NO: 1819 - protein, 5 aa, Chlamydia trachomatis
LSKMQ

SEQ ID NO: 1820 - protein, 5 aa, Chlamydia trachomatis
SKMQK

SEQ ID NO: 1821 - protein, 5 aa, Chlamydia trachomatis
KMQKG

SEQ ID NO: 1822 - protein, 5 aa, Chlamydia trachomatis
MQKGI

SEQ ID NO: 1823 - protein, 5 aa, Chlamydia trachomatis
QKGIS

SEQ ID NO: 1824 - protein, 5 aa, Chlamydia trachomatis
KGISS

SEQ ID NO: 1825 - protein, 5 aa, Chlamydia trachomatis
GISSC

SEQ ID NO: 1826 - protein, 5 aa, Chlamydia trachomatis
ISSCA

SEQ ID NO: 1827 - protein, 5 aa, Chlamydia trachomatis
SSCAN

SEQ ID NO: 1828 - protein, 5 aa, Chlamydia trachomatis
SCANL

SEQ ID NO: 1829 - protein, 5 aa, Chlamydia trachomatis
CANLV

SEQ ID NO: 1830 - protein, 5 aa, Chlamydia trachomatis
ANLVV

SEQ ID NO: 1831 - protein, 5 aa, Chlamydia trachomatis
NLVVT

SEQ ID NO: 1832 - protein, 5 aa, Chlamydia trachomatis
LVVTL

SEQ ID NO: 1833 - protein, 5 aa, Chlamydia trachomatis
VVTLL

SEQ ID NO: 1834 - protein, 5 aa, Chlamydia trachomatis
VTLLE

SEQ ID NO: 1835 - protein, 5 aa, Chlamydia trachomatis
TLLES

SEQ ID NO: 1836 - protein, 5 aa, Chlamydia trachomatis
LLESQ

SEQ ID NO: 1837 - protein, 5 aa, Chlamydia trachomatis
LESQL

SEQ ID NO: 1838 - protein, 5 aa, Chlamydia trachomatis
ESQLG

SEQ ID NO: 1839 - protein, 5 aa, Chlamydia trachomatis
SQLGT

SEQ ID NO: 1840 - protein, 5 aa, Chlamydia trachomatis
QLGTS

SEQ ID NO: 1841 - protein, 5 aa, Chlamydia trachomatis
LGTSG

SEQ ID NO: 1842 - protein, 5 aa, Chlamydia trachomatis
GTSGQ

SEQ ID NO: 1843 - protein, 5 aa, Chlamydia trachomatis
TSGQT

SEQ ID NO: 1844 - protein, 5 aa, Chlamydia trachomatis
SGQTP

SEQ ID NO: 1845 - protein, 5 aa, Chlamydia trachomatis
GQTPI

SEQ ID NO: 1846 - protein, 5 aa, Chlamydia trachomatis
QTPIK

SEQ ID NO: 1847 - protein, 5 aa, Chlamydia trachomatis
TPIKE

SEQ ID NO: 1848 - protein, 5 aa, Chlamydia trachomatis
PIKEV

SEQ ID NO: 1849 - protein, 5 aa, Chlamydia trachomatis
IKEVE

SEQ ID NO: 1850 - protein, 5 aa, Chlamydia trachomatis
KEVEE

SEQ ID NO: 1851 - protein, 5 aa, Chlamydia trachomatis
EVEES

SEQ ID NO: 1852 - protein, 5 aa, Chlamydia trachomatis
VEESI

SEQ ID NO: 1853 - protein, 5 aa, Chlamydia trachomatis
EESIY

SEQ ID NO: 1854 - protein, 5 aa, Chlamydia trachomatis
ESIYR

SEQ ID NO: 1855 - protein, 5 aa, Chlamydia trachomatis
SIYRD

SEQ ID NO: 1856 - protein, 5 aa, Chlamydia trachomatis
IYRDL

SEQ ID NO: 1857 - protein, 5 aa, Chlamydia trachomatis
YRDLI

SEQ ID NO: 1858 - protein, 5 aa, Chlamydia trachomatis
RDLIA

SEQ ID NO: 1859 - protein, 5 aa, Chlamydia trachomatis
DLIAT

SEQ ID NO: 1860 - protein, 5 aa, Chlamydia trachomatis
LIATI

SEQ ID NO: 1861 - protein, 5 aa, Chlamydia trachomatis
IATIL

SEQ ID NO: 1862 - protein, 5 aa, Chlamydia trachomatis
ATILQ

SEQ ID NO: 1863 - protein, 5 aa, Chlamydia trachomatis
TILQM

SEQ ID NO: 1864 - protein, 5 aa, Chlamydia trachomatis
ILQMG

SEQ ID NO: 1865 - protein, 5 aa, Chlamydia trachomatis
LQMGS

SEQ ID NO: 1866 - protein, 5 aa, Chlamydia trachomatis
QMGSA

SEQ ID NO: 1867 - protein, 5 aa, Chlamydia trachomatis
MGSAA

SEQ ID NO: 1868 - protein, 5 aa, Chlamydia trachomatis
GSAAG

SEQ ID NO: 1869 - protein, 5 aa, Chlamydia trachomatis
SAAGG

SEQ ID NO: 1870 - protein, 5 aa, Chlamydia trachomatis
AAGGV

SEQ ID NO: 1871 - protein, 5 aa, Chlamydia trachomatis
AGGVT

SEQ ID NO: 1872 - protein, 5 aa, Chlamydia trachomatis
GGVTP

SEQ ID NO: 1873 - protein, 5 aa, Chlamydia trachomatis
GVTPL

SEQ ID NO: 1874 - protein, 5 aa, Chlamydia trachomatis
VTPLV

SEQ ID NO: 1875 - protein, 5 aa, Chlamydia trachomatis
TPLVD

SEQ ID NO: 1876 - protein, 5 aa, Chlamydia trachomatis
PLVDG

SEQ ID NO: 1877 - protein, 5 aa, Chlamydia trachomatis
LVDGV

SEQ ID NO: 1878 - protein, 5 aa, Chlamydia trachomatis
VDGVH

SEQ ID NO: 1879 - protein, 5 aa, Chlamydia trachomatis
DGVHK

SEQ ID NO: 1880 - protein, 5 aa, Chlamydia trachomatis
GVHKA

SEQ ID NO: 1881 - protein, 5 aa, Chlamydia trachomatis
VHKAI

SEQ ID NO: 1882 - protein, 5 aa, Chlamydia trachomatis
HKAIR

SEQ ID NO: 1883 - protein, 5 aa, Chlamydia trachomatis
KAIRE

SEQ ID NO: 1884 - protein, 5 aa, Chlamydia trachomatis
AIREG

SEQ ID NO: 1885 - protein, 5 aa, Chlamydia trachomatis
IREGK

SEQ ID NO: 1886 - protein, 5 aa, Chlamydia trachomatis
REGKA

SEQ ID NO: 1887 - protein, 5 aa, Chlamydia trachomatis
EGKAL

SEQ ID NO: 1888 - protein, 5 aa, Chlamydia trachomatis
GKALR

SEQ ID NO: 1889 - protein, 5 aa, Chlamydia trachomatis
KALRS

SEQ ID NO: 1890 - protein, 5 aa, Chlamydia trachomatis
ALRSE

SEQ ID NO: 1891 - protein, 5 aa, Chlamydia trachomatis
LRSEL

SEQ ID NO: 1892 - protein, 5 aa, Chlamydia trachomatis
RSELS

SEQ ID NO: 1893 - protein, 5 aa, Chlamydia trachomatis
SELSR

SEQ ID NO: 1894 - protein, 5 aa, Chlamydia trachomatis
ELSRA

SEQ ID NO: 1895 - protein, 5 aa, Chlamydia trachomatis
LSRAM

SEQ ID NO: 1896 - protein, 5 aa, Chlamydia trachomatis
SRAMS

SEQ ID NO: 1897 - protein, 5 aa, Chlamydia trachomatis
RAMSL

SEQ ID NO: 1898 - protein, 5 aa, Chlamydia trachomatis
AMSLH

SEQ ID NO: 1899 - protein, 5 aa, Chlamydia trachomatis
MSLHP

SEQ ID NO: 1900 - protein, 5 aa, Chlamydia trachomatis
SLHPR

SEQ ID NO: 1901 - protein, 5 aa, Chlamydia trachomatis
LHPRQ

SEQ ID NO: 1902 - protein, 5 aa, Chlamydia trachomatis
HPRQS

SEQ ID NO: 1903 - protein, 5 aa, Chlamydia trachomatis
PRQSF

SEQ ID NO: 1904 - protein, 5 aa, Chlamydia trachomatis
RQSFL

SEQ ID NO: 1905 - protein, 5 aa, Chlamydia trachomatis
QSFLG

SEQ ID NO: 1906 - protein, 5 aa, Chlamydia trachomatis
SFLGV

SEQ ID NO: 1907 - protein, 5 aa, Chlamydia trachomatis
FLGVQ

SEQ ID NO: 1908 - protein, 5 aa, Chlamydia trachomatis
LGVQS

SEQ ID NO: 1909 - protein, 5 aa, Chlamydia trachomatis
GVQSA

SEQ ID NO: 1910 - protein, 5 aa, Chlamydia trachomatis
VQSAV

SEQ ID NO: 1911 - protein, 5 aa, Chlamydia trachomatis
QSAVE

SEQ ID NO: 1912 - protein, 5 aa, Chlamydia trachomatis
SAVEK

SEQ ID NO: 1913 - protein, 5 aa, Chlamydia trachomatis
AVEKL

SEQ ID NO: 1914 - protein, 5 aa, Chlamydia trachomatis
VEKLQ

SEQ ID NO: 1915 - protein, 5 aa, Chlamydia trachomatis
EKLQA

SEQ ID NO: 1916 - protein, 5 aa, Chlamydia trachomatis
KLQAF

SEQ ID NO: 1917 - protein, 5 aa, Chlamydia trachomatis
LQAFI

SEQ ID NO: 1918 - protein, 5 aa, Chlamydia trachomatis
QAFIR

SEQ ID NO: 1919 - protein, 5 aa, Chlamydia trachomatis
AFIRD

SEQ ID NO: 1920 - protein, 5 aa, Chlamydia trachomatis
FIRDP

SEQ ID NO: 1921 - protein, 5 aa, Chlamydia trachomatis
IRDPK

SEQ ID NO: 1922 - protein, 5 aa, Chlamydia trachomatis
RDPKW

SEQ ID NO: 1923 - protein, 5 aa, Chlamydia trachomatis
DPKWG

SEQ ID NO: 1924 - protein, 5 aa, Chlamydia trachomatis
PKWGA

SEQ ID NO: 1925 - protein, 5 aa, Chlamydia trachomatis
KWGAS

SEQ ID NO: 1926 - protein, 5 aa, Chlamydia trachomatis
WGASA

SEQ ID NO: 1927 - protein, 5 aa, Chlamydia trachomatis
GASAV

SEQ ID NO: 1928 - protein, 5 aa, Chlamydia trachomatis
ASAVH

SEQ ID NO: 1929 - protein, 5 aa, Chlamydia trachomatis
SAVHT

SEQ ID NO: 1930 - protein, 5 aa, Chlamydia trachomatis
AVHTS

SEQ ID NO: 1931 - protein, 5 aa, Chlamydia trachomatis
VHTSA

SEQ ID NO: 1932 - protein, 5 aa, Chlamydia trachomatis
HTSAE

SEQ ID NO: 1933 - protein, 5 aa, Chlamydia trachomatis
TSAEE

SEQ ID NO: 1934 - protein, 5 aa, Chlamydia trachomatis
SAEET

SEQ ID NO: 1935 - protein, 5 aa, Chlamydia trachomatis
AEETL

SEQ ID NO: 1936 - protein, 5 aa, Chlamydia trachomatis
EETLA

SEQ ID NO: 1937 - protein, 5 aa, Chlamydia trachomatis
ETLAQ

SEQ ID NO: 1938 - protein, 5 aa, Chlamydia trachomatis
TLAQK

SEQ ID NO: 1939 - protein, 5 aa, Chlamydia trachomatis
LAQKQ

SEQ ID NO: 1940 - protein, 5 aa, Chlamydia trachomatis
AQKQK

SEQ ID NO: 1941 - protein, 5 aa, Chlamydia trachomatis
QKQKF

SEQ ID NO: 1942 - protein, 5 aa, Chlamydia trachomatis
KQKFV

SEQ ID NO: 1943 - protein, 5 aa, Chlamydia trachomatis
QKFVS

SEQ ID NO: 1944 - protein, 5 aa, Chlamydia trachomatis
KFVSD

SEQ ID NO: 1945 - protein, 5 aa, Chlamydia trachomatis
FVSDL

SEQ ID NO: 1946 - protein, 5 aa, Chlamydia trachomatis
VSDLT

SEQ ID NO: 1947 - protein, 5 aa, Chlamydia trachomatis
SDLTR

SEQ ID NO: 1948 - protein, 5 aa, Chlamydia trachomatis
DLTRI

SEQ ID NO: 1949 - protein, 5 aa, Chlamydia trachomatis
LTRIQ

SEQ ID NO: 1950 - protein, 5 aa, Chlamydia trachomatis
TRIQT

SEQ ID NO: 1951 - protein, 5 aa, Chlamydia trachomatis
RIQTS

SEQ ID NO: 1952 - protein, 5 aa, Chlamydia trachomatis
IQTSL

SEQ ID NO: 1953 - protein, 5 aa, Chlamydia trachomatis
QTSLA

SEQ ID NO: 1954 - protein, 5 aa, Chlamydia trachomatis
TSLAD

SEQ ID NO: 1955 - protein, 5 aa, Chlamydia trachomatis
SLADW

SEQ ID NO: 1956 - protein, 5 aa, Chlamydia trachomatis
LADWR

SEQ ID NO: 1957 - protein, 5 aa, Chlamydia trachomatis
ADWRE

SEQ ID NO: 1958 - protein, 5 aa, Chlamydia trachomatis
DWRER

SEQ ID NO: 1959 - protein, 5 aa, Chlamydia trachomatis
WRERY

SEQ ID NO: 1960 - protein, 5 aa, Chlamydia trachomatis
RERYG

SEQ ID NO: 1961 - protein, 5 aa, Chlamydia trachomatis
ERYGL

SEQ ID NO: 1962 - protein, 5 aa, Chlamydia trachomatis
RYGLF

SEQ ID NO: 1963 - protein, 5 aa, Chlamydia trachomatis
YGLFE

SEQ ID NO: 1964 - protein, 5 aa, Chlamydia trachomatis
GLFEE

SEQ ID NO: 1965 - protein, 5 aa, Chlamydia trachomatis
LFEET

SEQ ID NO: 1966 - protein, 5 aa, Chlamydia trachomatis
FEETK

SEQ ID NO: 1967 - protein, 5 aa, Chlamydia trachomatis
EETKL

SEQ ID NO: 1968 - protein, 5 aa, Chlamydia trachomatis
ETKLN

SEQ ID NO: 1969 - protein, 5 aa, Chlamydia trachomatis
TKLNH

SEQ ID NO: 1970 - protein, 5 aa, Chlamydia trachomatis
KLNHI

SEQ ID NO: 1971 - protein, 5 aa, Chlamydia trachomatis
LNHIV

SEQ ID NO: 1972 - protein, 5 aa, Chlamydia trachomatis
NHIVS

SEQ ID NO: 1973 - protein, 5 aa, Chlamydia trachomatis
HIVST

SEQ ID NO: 1974 - protein, 5 aa, Chlamydia trachomatis
IVSTD

SEQ ID NO: 1975 - protein, 5 aa, Chlamydia trachomatis
VSTDF

SEQ ID NO: 1976 - protein, 5 aa, Chlamydia trachomatis
STDFV

SEQ ID NO: 1977 - protein, 5 aa, Chlamydia trachomatis
TDFVS

SEQ ID NO: 1978 - protein, 5 aa, Chlamydia trachomatis
DFVSR

SEQ ID NO: 1979 - protein, 5 aa, Chlamydia trachomatis
FVSRT

SEQ ID NO: 1980 - protein, 5 aa, Chlamydia trachomatis
VSRTE

SEQ ID NO: 1981 - protein, 5 aa, Chlamydia trachomatis
SRTEA

SEQ ID NO: 1982 - protein, 5 aa, Chlamydia trachomatis
RTEAF

SEQ ID NO: 1983 - protein, 5 aa, Chlamydia trachomatis
TEAFL

SEQ ID NO: 1984 - protein, 5 aa, Chlamydia trachomatis
EAFLD

SEQ ID NO: 1985 - protein, 5 aa, Chlamydia trachomatis
AFLDT

SEQ ID NO: 1986 - protein, 5 aa, Chlamydia trachomatis
FLDTL

SEQ ID NO: 1987 - protein, 5 aa, Chlamydia trachomatis
LDTLK

SEQ ID NO: 1988 - protein, 5 aa, Chlamydia trachomatis
DTLKN

SEQ ID NO: 1989 - protein, 5 aa, Chlamydia trachomatis
TLKNV

SEQ ID NO: 1990 - protein, 5 aa, Chlamydia trachomatis
LKNVA

SEQ ID NO: 1991 - protein, 5 aa, Chlamydia trachomatis
KNVAE

SEQ ID NO: 1992 - protein, 5 aa, Chlamydia trachomatis
NVAEA

SEQ ID NO: 1993 - protein, 5 aa, Chlamydia trachomatis
VAEAC

SEQ ID NO: 1994 - protein, 5 aa, Chlamydia trachomatis
AEACS

SEQ ID NO: 1995 - protein, 5 aa, Chlamydia trachomatis
EACSL

SEQ ID NO: 1996 - protein, 5 aa, Chlamydia trachomatis
ACSLE

SEQ ID NO: 1997 - protein, 5 aa, Chlamydia trachomatis
CSLEQ

SEQ ID NO: 1998 - protein, 5 aa, Chlamydia trachomatis
SLEQA

SEQ ID NO: 1999 - protein, 5 aa, Chlamydia trachomatis
LEQAV

SEQ ID NO: 2000 - protein, 5 aa, Chlamydia trachomatis
EQAVA

SEQ ID NO: 2001 - protein, 5 aa, Chlamydia trachomatis
QAVAE

SEQ ID NO: 2002 - protein, 5 aa, Chlamydia trachomatis
AVAEL

SEQ ID NO: 2003 - protein, 5 aa, Chlamydia trachomatis
VAELK

SEQ ID NO: 2004 - protein, 5 aa, Chlamydia trachomatis
AELKD

SEQ ID NO: 2005 - protein, 5 aa, Chlamydia trachomatis
ELKDC

SEQ ID NO: 2006 - protein, 5 aa, Chlamydia trachomatis
LKDCE

SEQ ID NO: 2007 - protein, 5 aa, Chlamydia trachomatis
KDCED

SEQ ID NO: 2008 - protein, 5 aa, Chlamydia trachomatis
DCEDA

SEQ ID NO: 2009 - protein, 5 aa, Chlamydia trachomatis
CEDAM

SEQ ID NO: 2010 - protein, 5 aa, Chlamydia trachomatis
EDAMK

SEQ ID NO: 2011 - protein, 5 aa, Chlamydia trachomatis
DAMKA

SEQ ID NO: 2012 - protein, 5 aa, Chlamydia trachomatis
AMKAD

SEQ ID NO: 2013 - protein, 5 aa, Chlamydia trachomatis
MKADL

SEQ ID NO: 2014 - protein, 5 aa, Chlamydia trachomatis
KADLT

SEQ ID NO: 2015 - protein, 5 aa, Chlamydia trachomatis
ADLTH

SEQ ID NO: 2016 - protein, 5 aa, Chlamydia trachomatis
DLTHV

SEQ ID NO: 2017 - protein, 5 aa, Chlamydia trachomatis
LTHVE

SEQ ID NO: 2018 - protein, 5 aa, Chlamydia trachomatis
THVEQ

SEQ ID NO: 2019 - protein, 5 aa, Chlamydia trachomatis
HVEQK

SEQ ID NO: 2020 - protein, 5 aa, Chlamydia trachomatis
VEQKM

SEQ ID NO: 2021 - protein, 5 aa, Chlamydia trachomatis
EQKMN

SEQ ID NO: 2022 - protein, 5 aa, Chlamydia trachomatis
QKMNP

SEQ ID NO: 2023 - protein, 5 aa, Chlamydia trachomatis
KMNPT

SEQ ID NO: 2024 - protein, 5 aa, Chlamydia trachomatis
MNPTE

SEQ ID NO: 2025 - protein, 5 aa, Chlamydia trachomatis
NPTEI

SEQ ID NO: 2026 - protein, 5 aa, Chlamydia trachomatis
PTEIE

SEQ ID NO: 2027 - protein, 5 aa, Chlamydia trachomatis
TEIES

SEQ ID NO: 2028 - protein, 5 aa, Chlamydia trachomatis
EIESA

SEQ ID NO: 2029 - protein, 5 aa, Chlamydia trachomatis
IESAR

SEQ ID NO: 2030 - protein, 5 aa, Chlamydia trachomatis
ESARE

SEQ ID NO: 2031 - protein, 5 aa, Chlamydia trachomatis
SAREE

SEQ ID NO: 2032 - protein, 5 aa, Chlamydia trachomatis
AREEF

SEQ ID NO: 2033 - protein, 5 aa, Chlamydia trachomatis
REEFK

SEQ ID NO: 2034 - protein, 5 aa, Chlamydia trachomatis
EEFKR

SEQ ID NO: 2035 - protein, 5 aa, Chlamydia trachomatis
EFKRL

SEQ ID NO: 2036 - protein, 5 aa, Chlamydia trachomatis
FKRLM

SEQ ID NO: 2037 - protein, 5 aa, Chlamydia trachomatis
KRLME

SEQ ID NO: 2038 - protein, 5 aa, Chlamydia trachomatis
RLMEE

SEQ ID NO: 2039 - protein, 5 aa, Chlamydia trachomatis
LMEEL

SEQ ID NO: 2040 - protein, 5 aa, Chlamydia trachomatis
MEELA

SEQ ID NO: 2041 - protein, 5 aa, Chlamydia trachomatis
EELAG

SEQ ID NO: 2042 - protein, 5 aa, Chlamydia trachomatis
ELAGI

SEQ ID NO: 2043 - protein, 5 aa, Chlamydia trachomatis
LAGIQ

SEQ ID NO: 2044 - protein, 5 aa, Chlamydia trachomatis
AGIQE

SEQ ID NO: 2045 - protein, 5 aa, Chlamydia trachomatis
GIQEQ

SEQ ID NO: 2046 - protein, 5 aa, Chlamydia trachomatis
IQEQL

SEQ ID NO: 2047 - protein, 5 aa, Chlamydia trachomatis
QEQLE

SEQ ID NO: 2048 - protein, 5 aa, Chlamydia trachomatis
EQLEQ

SEQ ID NO: 2049 - protein, 5 aa, Chlamydia trachomatis
QLEQI

SEQ ID NO: 2050 - protein, 5 aa, Chlamydia trachomatis
LEQIA

SEQ ID NO: 2051 - protein, 5 aa, Chlamydia trachomatis
EQIAQ

SEQ ID NO: 2052 - protein, 5 aa, Chlamydia trachomatis
QIAQP

SEQ ID NO: 2053 - protein, 5 aa, Chlamydia trachomatis
IAQPI

SEQ ID NO: 2054 - protein, 5 aa, Chlamydia trachomatis
AQPIY

SEQ ID NO: 2055 - protein, 5 aa, Chlamydia trachomatis
QPIYE

SEQ ID NO: 2056 - protein, 5 aa, Chlamydia trachomatis
PIYEE

SEQ ID NO: 2057 - protein, 5 aa, Chlamydia trachomatis
IYEEG

SEQ ID NO: 2058 - protein, 5 aa, Chlamydia trachomatis
YEEGV

SEQ ID NO: 2059 - protein, 5 aa, Chlamydia trachomatis
EEGVS

SEQ ID NO: 2060 - protein, 5 aa, Chlamydia trachomatis
EGVSG

SEQ ID NO: 2061 - protein, 5 aa, Chlamydia trachomatis
GVSGE

SEQ ID NO: 2062 - protein, 5 aa, Chlamydia trachomatis
VSGER

SEQ ID NO: 2063 - protein, 5 aa, Chlamydia trachomatis
SGERL

SEQ ID NO: 2064 - protein, 5 aa, Chlamydia trachomatis
GERLL

SEQ ID NO: 2065 - protein, 5 aa, Chlamydia trachomatis
ERLLL

SEQ ID NO: 2066 - protein, 5 aa, Chlamydia trachomatis
RLLLN

SEQ ID NO: 2067 - protein, 5 aa, Chlamydia trachomatis
LLLNT

SEQ ID NO: 2068 - protein, 5 aa, Chlamydia trachomatis
LLNTV

SEQ ID NO: 2069 - protein, 5 aa, Chlamydia trachomatis
LNTVF

SEQ ID NO: 2070 - protein, 5 aa, Chlamydia trachomatis
NTVFF

SEQ ID NO: 2071 - protein, 5 aa, Chlamydia trachomatis
TVFFH

SEQ ID NO: 2072 - protein, 5 aa, Chlamydia trachomatis
VFFHP

SEQ ID NO: 2073 - protein, 5 aa, Chlamydia trachomatis
FFHPE

SEQ ID NO: 2074 - protein, 5 aa, Chlamydia trachomatis
FHPEV

SEQ ID NO: 2075 - protein, 5 aa, Chlamydia trachomatis
HPEVL

SEQ ID NO: 2076 - protein, 5 aa, Chlamydia trachomatis
PEVLR

SEQ ID NO: 2077 - protein, 5 aa, Chlamydia trachomatis
EVLRK

SEQ ID NO: 2078 - protein, 5 aa, Chlamydia trachomatis
VLRKK

SEQ ID NO: 2079 - protein, 5 aa, Chlamydia trachomatis
LRKKV

SEQ ID NO: 2080 - protein, 5 aa, Chlamydia trachomatis
RKKVQ

SEQ ID NO: 2081 - protein, 5 aa, Chlamydia trachomatis
KKVQA

SEQ ID NO: 2082 - protein, 5 aa, Chlamydia trachomatis
KVQAK

SEQ ID NO: 2083 - protein, 5 aa, Chlamydia trachomatis
VQAKE

SEQ ID NO: 2084 - protein, 5 aa, Chlamydia trachomatis
QAKEA

SEQ ID NO: 2085 - protein, 5 aa, Chlamydia trachomatis
AKEAS

SEQ ID NO: 2086 - protein, 5 aa, Chlamydia trachomatis
KEASL

SEQ ID NO: 2087 - protein, 5 aa, Chlamydia trachomatis
EASLE

SEQ ID NO: 2088 - protein, 5 aa, Chlamydia trachomatis
ASLEA

SEQ ID NO: 2089 - protein, 5 aa, Chlamydia trachomatis
SLEAL

SEQ ID NO: 2090 - protein, 5 aa, Chlamydia trachomatis
LEALT

SEQ ID NO: 2091 - protein, 5 aa, Chlamydia trachomatis
EALTK

SEQ ID NO: 2092 - protein, 5 aa, Chlamydia trachomatis
ALTKG

SEQ ID NO: 2093 - protein, 5 aa, Chlamydia trachomatis
LTKGE

SEQ ID NO: 2094 - protein, 5 aa, Chlamydia trachomatis
TKGEQ

SEQ ID NO: 2095 - protein, 5 aa, Chlamydia trachomatis
KGEQP

SEQ ID NO: 2096 - protein, 5 aa, Chlamydia trachomatis
GEQPS

SEQ ID NO: 2097 - protein, 5 aa, Chlamydia trachomatis
EQPSP

SEQ ID NO: 2098 - protein, 5 aa, Chlamydia trachomatis
QPSPT

SEQ ID NO: 2099 - protein, 5 aa, Chlamydia trachomatis
PSPTK

SEQ ID NO: 2100 - protein, 5 aa, Chlamydia trachomatis
SPTKK

SEQ ID NO: 2101 - protein, 5 aa, Chlamydia trachomatis
PTKKK

SEQ ID NO: 2102 - protein, 5 aa, Chlamydia trachomatis
TKKKT

SEQ ID NO: 2103 - protein, 5 aa, Chlamydia trachomatis
KKKTL

SEQ ID NO: 2104 - protein, 5 aa, Chlamydia trachomatis
KKTLK

SEQ ID NO: 2105 - protein, 5 aa, Chlamydia trachomatis
KTLKQ

SEQ ID NO: 2106 - protein, 5 aa, Chlamydia trachomatis
TLKQL

SEQ ID NO: 2107 - protein, 5 aa, Chlamydia trachomatis
LKQLS

SEQ ID NO: 2108 - protein, 5 aa, Chlamydia trachomatis
KQLSE

SEQ ID NO: 2109 - protein, 5 aa, Chlamydia trachomatis
QLSEG

SEQ ID NO: 2110 - protein, 5 aa, Chlamydia trachomatis
LSEGC

SEQ ID NO: 2111 - protein, 5 aa, Chlamydia trachomatis
SEGCE

SEQ ID NO: 2112 - protein, 5 aa, Chlamydia trachomatis
EGCEY

SEQ ID NO: 2113 - protein, 5 aa, Chlamydia trachomatis
GCEYF

SEQ ID NO: 2114 - protein, 5 aa, Chlamydia trachomatis
CEYFS

SEQ ID NO: 2115 - protein, 5 aa, Chlamydia trachomatis
EYFSS

SEQ ID NO: 2116 - protein, 5 aa, Chlamydia trachomatis
YFSSL

SEQ ID NO: 2117 - protein, 5 aa, Chlamydia trachomatis
FSSLV

SEQ ID NO: 2118 - protein, 5 aa, Chlamydia trachomatis
SSLVS

SEQ ID NO: 2119 - protein, 5 aa, Chlamydia trachomatis
SLVSK

SEQ ID NO: 2120 - protein, 5 aa, Chlamydia trachomatis
LVSKI

SEQ ID NO: 2121 - protein, 5 aa, Chlamydia trachomatis
VSKIN

SEQ ID NO: 2122 - protein, 5 aa, Chlamydia trachomatis
SKINA

SEQ ID NO: 2123 - protein, 5 aa, Chlamydia trachomatis
KINAL

SEQ ID NO: 2124 - protein, 5 aa, Chlamydia trachomatis
INALK

SEQ ID NO: 2125 - protein, 5 aa, Chlamydia trachomatis
NALKT

SEQ ID NO: 2126 - protein, 5 aa, Chlamydia trachomatis
ALKTI

SEQ ID NO: 2127 - protein, 5 aa, Chlamydia trachomatis
LKTIL

SEQ ID NO: 2128 - protein, 5 aa, Chlamydia trachomatis
KTILE

SEQ ID NO: 2129 - protein, 5 aa, Chlamydia trachomatis
TILEG

SEQ ID NO: 2130 - protein, 5 aa, Chlamydia trachomatis
ILEGS

SEQ ID NO: 2131 - protein, 5 aa, Chlamydia trachomatis
LEGSR

SEQ ID NO: 2132 - protein, 5 aa, Chlamydia trachomatis
EGSRG

SEQ ID NO: 2133 - protein, 5 aa, Chlamydia trachomatis
GSRGK

SEQ ID NO: 2134 - protein, 5 aa, Chlamydia trachomatis
SRGKK

SEQ ID NO: 2135 - protein, 5 aa, Chlamydia trachomatis
RGKKI

SEQ ID NO: 2136 - protein, 5 aa, Chlamydia trachomatis
GKKIA

SEQ ID NO: 2137 - protein, 5 aa, Chlamydia trachomatis
KKIAS

SEQ ID NO: 2138 - protein, 5 aa, Chlamydia trachomatis
KIASQ

SEQ ID NO: 2139 - protein, 5 aa, Chlamydia trachomatis
IASQD

SEQ ID NO: 2140 - protein, 5 aa, Chlamydia trachomatis
ASQDI

SEQ ID NO: 2141 - protein, 5 aa, Chlamydia trachomatis
SQDIR

SEQ ID NO: 2142 - protein, 5 aa, Chlamydia trachomatis
QDIRQ

SEQ ID NO: 2143 - protein, 5 aa, Chlamydia trachomatis
DIRQL

SEQ ID NO: 2144 - protein, 5 aa, Chlamydia trachomatis
IRQLI

SEQ ID NO: 2145 - protein, 5 aa, Chlamydia trachomatis
RQLIG

SEQ ID NO: 2146 - protein, 5 aa, Chlamydia trachomatis
QLIGL

SEQ ID NO: 2147 - protein, 5 aa, Chlamydia trachomatis
LIGLT

SEQ ID NO: 2148 - protein, 5 aa, Chlamydia trachomatis
IGLTD

SEQ ID NO: 2149 - protein, 5 aa, Chlamydia trachomatis
GLTDE

SEQ ID NO: 2150 - protein, 5 aa, Chlamydia trachomatis
LTDEL

SEQ ID NO: 2151 - protein, 5 aa, Chlamydia trachomatis
TDELA

SEQ ID NO: 2152 - protein, 5 aa, Chlamydia trachomatis
DELAL

SEQ ID NO: 2153 - protein, 5 aa, Chlamydia trachomatis
ELALE

SEQ ID NO: 2154 - protein, 5 aa, Chlamydia trachomatis
LALEL

SEQ ID NO: 2155 - protein, 5 aa, Chlamydia trachomatis
ALELS

SEQ ID NO: 2156 - protein, 5 aa, Chlamydia trachomatis
LELSS

SEQ ID NO: 2157 - protein, 5 aa, Chlamydia trachomatis
ELSSF

SEQ ID NO: 2158 - protein, 5 aa, Chlamydia trachomatis
LSSFQ

SEQ ID NO: 2159 - protein, 5 aa, Chlamydia trachomatis
SSFQQ

SEQ ID NO: 2160 - protein, 5 aa, Chlamydia trachomatis
SFQQD

SEQ ID NO: 2161 - protein, 5 aa, Chlamydia trachomatis
FQQDS

SEQ ID NO: 2162 - protein, 5 aa, Chlamydia trachomatis
QQDSL

SEQ ID NO: 2163 - protein, 5 aa, Chlamydia trachomatis
QDSLE

SEQ ID NO: 2164 - protein, 5 aa, Chlamydia trachomatis
DSLES

SEQ ID NO: 2165 - protein, 5 aa, Chlamydia trachomatis
SLESL

SEQ ID NO: 2166 - protein, 5 aa, Chlamydia trachomatis
LESLL

SEQ ID NO: 2167 - protein, 5 aa, Chlamydia trachomatis
ESLLY

SEQ ID NO: 2168 - protein, 5 aa, Chlamydia trachomatis
SLLYG

SEQ ID NO: 2169 - protein, 5 aa, Chlamydia trachomatis
LLYGL

SEQ ID NO: 2170 - protein, 5 aa, Chlamydia trachomatis
LYGLE

SEQ ID NO: 2171 - protein, 5 aa, Chlamydia trachomatis
YGLEG

SEQ ID NO: 2172 - protein, 5 aa, Chlamydia trachomatis
GLEGL

SEQ ID NO: 2173 - protein, 5 aa, Chlamydia trachomatis
LEGLS

SEQ ID NO: 2174 - protein, 5 aa, Chlamydia trachomatis
EGLSI

SEQ ID NO: 2175 - protein, 5 aa, Chlamydia trachomatis
GLSIP

SEQ ID NO: 2176 - protein, 5 aa, Chlamydia trachomatis
LSIPA

SEQ ID NO: 2177 - protein, 5 aa, Chlamydia trachomatis
SIPAA

SEQ ID NO: 2178 - protein, 5 aa, Chlamydia trachomatis
IPAAS

SEQ ID NO: 2179 - protein, 5 aa, Chlamydia trachomatis
PAASI

SEQ ID NO: 2180 - protein, 5 aa, Chlamydia trachomatis
AASIE

SEQ ID NO: 2181 - protein, 5 aa, Chlamydia trachomatis
ASIEQ

SEQ ID NO: 2182 - protein, 5 aa, Chlamydia trachomatis
SIEQK

SEQ ID NO: 2183 - protein, 5 aa, Chlamydia trachomatis
IEQKK

SEQ ID NO: 2184 - protein, 5 aa, Chlamydia trachomatis
EQKKG

SEQ ID NO: 2185 - protein, 5 aa, Chlamydia trachomatis
QKKGS

SEQ ID NO: 2186 - protein, 5 aa, Chlamydia trachomatis
KKGSP

SEQ ID NO: 2187 - protein, 5 aa, Chlamydia trachomatis
KGSPK

SEQ ID NO: 2188 - protein, 5 aa, Chlamydia trachomatis
GSPKS

SEQ ID NO: 2189 - protein, 5 aa, Chlamydia trachomatis
SPKSS

SEQ ID NO: 2190 - protein, 5 aa, Chlamydia trachomatis
PKSSS

SEQ ID NO: 2191 - protein, 5 aa, Chlamydia trachomatis
KSSSI

SEQ ID NO: 2192 - protein, 5 aa, Chlamydia trachomatis
SSSIA

SEQ ID NO: 2193 - protein, 5 aa, Chlamydia trachomatis
SSIAE

SEQ ID NO: 2194 - protein, 5 aa, Chlamydia trachomatis
SIAEK

SEQ ID NO: 2195 - protein, 5 aa, Chlamydia trachomatis
IAEKV

SEQ ID NO: 2196 - protein, 5 aa, Chlamydia trachomatis
AEKVV

SEQ ID NO: 2197 - protein, 5 aa, Chlamydia trachomatis
EKVVY

SEQ ID NO: 2198 - protein, 5 aa, Chlamydia trachomatis
KVVYA

SEQ ID NO: 2199 - protein, 5 aa, Chlamydia trachomatis
VVYAS

SEQ ID NO: 2200 - protein, 5 aa, Chlamydia trachomatis
VYASH

SEQ ID NO: 2201 - protein, 5 aa, Chlamydia trachomatis
YASHQ

SEQ ID NO: 2202 - protein, 5 aa, Chlamydia trachomatis
ASHQR

SEQ ID NO: 2203 - protein, 5 aa, Chlamydia trachomatis
SHQRV

SEQ ID NO: 2204 - protein, 5 aa, Chlamydia trachomatis
HQRVH

SEQ ID NO: 2205 - protein, 5 aa, Chlamydia trachomatis
QRVHN

SEQ ID NO: 2206 - protein, 5 aa, Chlamydia trachomatis
RVHNG

SEQ ID NO: 2207 - protein, 5 aa, Chlamydia trachomatis
VHNGV

SEQ ID NO: 2208 - protein, 5 aa, Chlamydia trachomatis
HNGVK

SEQ ID NO: 2209 - protein, 5 aa, Chlamydia trachomatis
NGVKA

SEQ ID NO: 2210 - protein, 5 aa, Chlamydia trachomatis
GVKAK

SEQ ID NO: 2211 - protein, 5 aa, Chlamydia trachomatis
VKAKV

SEQ ID NO: 2212 - protein, 5 aa, Chlamydia trachomatis
KAKVN

SEQ ID NO: 2213 - protein, 5 aa, Chlamydia trachomatis
AKVNR

SEQ ID NO: 2214 - protein, 5 aa, Chlamydia trachomatis
KVNRT

SEQ ID NO: 2215 - protein, 5 aa, Chlamydia trachomatis
VNRTL

SEQ ID NO: 2216 - protein, 5 aa, Chlamydia trachomatis
NRTLE

SEQ ID NO: 2217 - protein, 5 aa, Chlamydia trachomatis
RTLEA

SEQ ID NO: 2218 - protein, 5 aa, Chlamydia trachomatis
TLEAF

SEQ ID NO: 2219 - protein, 5 aa, Chlamydia trachomatis
LEAFS

SEQ ID NO: 2220 - protein, 5 aa, Chlamydia trachomatis
EAFSQ

SEQ ID NO: 2221 - protein, 5 aa, Chlamydia trachomatis
AFSQL

SEQ ID NO: 2222 - protein, 5 aa, Chlamydia trachomatis
FSQLI

SEQ ID NO: 2223 - protein, 5 aa, Chlamydia trachomatis
SQLIK

SEQ ID NO: 2224 - protein, 5 aa, Chlamydia trachomatis
QLIKG

SEQ ID NO: 2225 - protein, 5 aa, Chlamydia trachomatis
LIKGL

SEQ ID NO: 2226 - protein, 5 aa, Chlamydia trachomatis
IKGLR

SEQ ID NO: 2227 - protein, 5 aa, Chlamydia trachomatis
KGLRG

SEQ ID NO: 2228 - protein, 5 aa, Chlamydia trachomatis
GLRGS

SEQ ID NO: 2229 - protein, 5 aa, Chlamydia trachomatis
LRGSL

SEQ ID NO: 2230 - protein, 5 aa, Chlamydia trachomatis
RGSLR

SEQ ID NO: 2231 - protein, 5 aa, Chlamydia trachomatis
GSLRN

SEQ ID NO: 2232 - protein, 5 aa, Chlamydia trachomatis
SLRNA

SEQ ID NO: 2233 - protein, 5 aa, Chlamydia trachomatis
LRNAM

SEQ ID NO: 2234 - protein, 5 aa, Chlamydia trachomatis
RNAMI

SEQ ID NO: 2235 - protein, 5 aa, Chlamydia trachomatis
NAMIT

SEQ ID NO: 2236 - protein, 5 aa, Chlamydia trachomatis
AMITK

SEQ ID NO: 2237 - protein, 5 aa, Chlamydia trachomatis
MITKA

SEQ ID NO: 2238 - protein, 5 aa, Chlamydia trachomatis
ITKAV

SEQ ID NO: 2239 - protein, 5 aa, Chlamydia trachomatis
TKAVV

SEQ ID NO: 2240 - protein, 5 aa, Chlamydia trachomatis
KAVVA

SEQ ID NO: 2241 - protein, 5 aa, Chlamydia trachomatis
AVVAA

SEQ ID NO: 2242 - protein, 5 aa, Chlamydia trachomatis
VVAAV

SEQ ID NO: 2243 - protein, 5 aa, Chlamydia trachomatis
VAAVL

SEQ ID NO: 2244 - protein, 5 aa, Chlamydia trachomatis
AAVLS

SEQ ID NO: 2245 - protein, 5 aa, Chlamydia trachomatis
AVLSV

SEQ ID NO: 2246 - protein, 5 aa, Chlamydia trachomatis
VLSVA

SEQ ID NO: 2247 - protein, 5 aa, Chlamydia trachomatis
LSVAF

SEQ ID NO: 2248 - protein, 5 aa, Chlamydia trachomatis
SVAFS

SEQ ID NO: 2249 - protein, 5 aa, Chlamydia trachomatis
VAFSC

SEQ ID NO: 2250 - protein, 5 aa, Chlamydia trachomatis
AFSCL

SEQ ID NO: 2251 - protein, 5 aa, Chlamydia trachomatis
FSCLA

SEQ ID NO: 2252 - protein, 5 aa, Chlamydia trachomatis
SCLAI

SEQ ID NO: 2253 - protein, 5 aa, Chlamydia trachomatis
CLAIA

SEQ ID NO: 2254 - protein, 5 aa, Chlamydia trachomatis
LAIAL

SEQ ID NO: 2255 - protein, 5 aa, Chlamydia trachomatis
AIALF

SEQ ID NO: 2256 - protein, 5 aa, Chlamydia trachomatis
IALFS

SEQ ID NO: 2257 - protein, 5 aa, Chlamydia trachomatis
ALFSV

SEQ ID NO: 2258 - protein, 5 aa, Chlamydia trachomatis
LFSVQ

SEQ ID NO: 2259 - protein, 5 aa, Chlamydia trachomatis
FSVQL

SEQ ID NO: 2260 - protein, 5 aa, Chlamydia trachomatis
SVQLT

SEQ ID NO: 2261 - protein, 5 aa, Chlamydia trachomatis
VQLTW

SEQ ID NO: 2262 - protein, 5 aa, Chlamydia trachomatis
QLTWL

SEQ ID NO: 2263 - protein, 5 aa, Chlamydia trachomatis
LTWLP

SEQ ID NO: 2264 - protein, 5 aa, Chlamydia trachomatis
TWLPI

SEQ ID NO: 2265 - protein, 5 aa, Chlamydia trachomatis
WLPIM

SEQ ID NO: 2266 - protein, 5 aa, Chlamydia trachomatis
LPIML

SEQ ID NO: 2267 - protein, 5 aa, Chlamydia trachomatis
PIMLC

SEQ ID NO: 2268 - protein, 5 aa, Chlamydia trachomatis
IMLCV

SEQ ID NO: 2269 - protein, 5 aa, Chlamydia trachomatis
MLCVL

SEQ ID NO: 2270 - protein, 5 aa, Chlamydia trachomatis
LCVLA

SEQ ID NO: 2271 - protein, 5 aa, Chlamydia trachomatis
CVLAL

SEQ ID NO: 2272 - protein, 5 aa, Chlamydia trachomatis
VLALV

SEQ ID NO: 2273 - protein, 5 aa, Chlamydia trachomatis
LALVL

SEQ ID NO: 2274 - protein, 5 aa, Chlamydia trachomatis
ALVLE

SEQ ID NO: 2275 - protein, 5 aa, Chlamydia trachomatis
LVLEA

SEQ ID NO: 2276 - protein, 5 aa, Chlamydia trachomatis
VLEAI

SEQ ID NO: 2277 - protein, 5 aa, Chlamydia trachomatis
LEAIP

SEQ ID NO: 2278 - protein, 5 aa, Chlamydia trachomatis
EAIPS

SEQ ID NO: 2279 - protein, 5 aa, Chlamydia trachomatis
AIPSA

SEQ ID NO: 2280 - protein, 5 aa, Chlamydia trachomatis
IPSAL

SEQ ID NO: 2281 - protein, 5 aa, Chlamydia trachomatis
PSALS

SEQ ID NO: 2282 - protein, 5 aa, Chlamydia trachomatis
SALSI

SEQ ID NO: 2283 - protein, 5 aa, Chlamydia trachomatis
ALSIW

SEQ ID NO: 2284 - protein, 5 aa, Chlamydia trachomatis
LSIWV

SEQ ID NO: 2285 - protein, 5 aa, Chlamydia trachomatis
SIWVE

SEQ ID NO: 2286 - protein, 5 aa, Chlamydia trachomatis
IWVEK

SEQ ID NO: 2287 - protein, 5 aa, Chlamydia trachomatis
WVEKR

SEQ ID NO: 2288 - protein, 5 aa, Chlamydia trachomatis
VEKRN

SEQ ID NO: 2289 - protein, 5 aa, Chlamydia trachomatis
EKRNW

SEQ ID NO: 2290 - protein, 5 aa, Chlamydia trachomatis
KRNWK

SEQ ID NO: 2291 - protein, 5 aa, Chlamydia trachomatis
RNWKY

SEQ ID NO: 2292 - protein, 5 aa, Chlamydia trachomatis
NWKYE

SEQ ID NO: 2293 - protein, 5 aa, Chlamydia trachomatis
WKYEV

SEQ ID NO: 2294 - protein, 5 aa, Chlamydia trachomatis
KYEVA

SEQ ID NO: 2295 - protein, 5 aa, Chlamydia trachomatis
YEVAS

SEQ ID NO: 2296 - protein, 5 aa, Chlamydia trachomatis
EVASL

SEQ ID NO: 2297 - protein, 5 aa, Chlamydia trachomatis
VASLA

SEQ ID NO: 2298 - protein, 5 aa, Chlamydia trachomatis
ASLAK

SEQ ID NO: 2299 - protein, 5 aa, Chlamydia trachomatis
SLAKQ

SEQ ID NO: 2300 - protein, 5 aa, Chlamydia trachomatis
LAKQL

SEQ ID NO: 2301 - protein, 5 aa, Chlamydia trachomatis
AKQLV

SEQ ID NO: 2302 - protein, 5 aa, Chlamydia trachomatis
KQLVS

SEQ ID NO: 2303 - protein, 5 aa, Chlamydia trachomatis
QLVSD

SEQ ID NO: 2304 - protein, 5 aa, Chlamydia trachomatis
LVSDG

SEQ ID NO: 2305 - protein, 5 aa, Chlamydia trachomatis
VSDGR

SEQ ID NO: 2306 - protein, 5 aa, Chlamydia trachomatis
SDGRK

SEQ ID NO: 2307 - protein, 5 aa, Chlamydia trachomatis
DGRKL

SEQ ID NO: 2308 - protein, 5 aa, Chlamydia trachomatis
GRKLP

SEQ ID NO: 2309 - protein, 5 aa, Chlamydia trachomatis
RKLPY

SEQ ID NO: 2310 - protein, 5 aa, Chlamydia trachomatis
KLPYP

SEQ ID NO: 2311 - protein, 5 aa, Chlamydia trachomatis
LPYPD

SEQ ID NO: 2312 - protein, 5 aa, Chlamydia trachomatis
PYPDL

SEQ ID NO: 2313 - protein, 5 aa, Chlamydia trachomatis
YPDLG

SEQ ID NO: 2314 - protein, 5 aa, Chlamydia trachomatis
PDLGD

SEQ ID NO: 2315 - protein, 5 aa, Chlamydia trachomatis
DLGDQ

SEQ ID NO: 2316 - protein, 5 aa, Chlamydia trachomatis
LGDQN

SEQ ID NO: 2317 - protein, 5 aa, Chlamydia trachomatis
GDQNI

SEQ ID NO: 2318 - protein, 5 aa, Chlamydia trachomatis
DQNIK

SEQ ID NO: 2319 - protein, 5 aa, Chlamydia trachomatis
QNIKH

SEQ ID NO: 2320 - protein, 5 aa, Chlamydia trachomatis
NIKHL

SEQ ID NO: 2321 - protein, 5 aa, Chlamydia trachomatis
IKHLE

SEQ ID NO: 2322 - protein, 5 aa, Chlamydia trachomatis
KHLEK

SEQ ID NO: 2323 - protein, 5 aa, Chlamydia trachomatis
HLEKI

SEQ ID NO: 2324 - protein, 5 aa, Chlamydia trachomatis
LEKIR

SEQ ID NO: 2325 - protein, 5 aa, Chlamydia trachomatis
EKIRD

SEQ ID NO: 2326 - protein, 5 aa, Chlamydia trachomatis
KIRDV

SEQ ID NO: 2327 - protein, 5 aa, Chlamydia trachomatis
IRDVY

SEQ ID NO: 2328 - protein, 5 aa, Chlamydia trachomatis
RDVYG

SEQ ID NO: 2329 - protein, 5 aa, Chlamydia trachomatis
DVYGL

SEQ ID NO: 2330 - protein, 5 aa, Chlamydia trachomatis
VYGLD

SEQ ID NO: 2331 - protein, 5 aa, Chlamydia trachomatis
YGLDG

SEQ ID NO: 2332 - protein, 5 aa, Chlamydia trachomatis
GLDGV

SEQ ID NO: 2333 - protein, 5 aa, Chlamydia trachomatis
LDGVA

SEQ ID NO: 2334 - protein, 5 aa, Chlamydia trachomatis
DGVAE

SEQ ID NO: 2335 - protein, 5 aa, Chlamydia trachomatis
GVAEL

SEQ ID NO: 2336 - protein, 5 aa, Chlamydia trachomatis
VAELR

SEQ ID NO: 2337 - protein, 5 aa, Chlamydia trachomatis
AELRV

SEQ ID NO: 2338 - protein, 5 aa, Chlamydia trachomatis
ELRVA

SEQ ID NO: 2339 - protein, 5 aa, Chlamydia trachomatis
LRVAE

SEQ ID NO: 2340 - protein, 5 aa, Chlamydia trachomatis
RVAEA

SEQ ID NO: 2341 - protein, 5 aa, Chlamydia trachomatis
VAEAA

SEQ ID NO: 2342 - protein, 5 aa, Chlamydia trachomatis
AEAAL

SEQ ID NO: 2343 - protein, 5 aa, Chlamydia trachomatis
EAALL

SEQ ID NO: 2344 - protein, 5 aa, Chlamydia trachomatis
AALLG

SEQ ID NO: 2345 - protein, 5 aa, Chlamydia trachomatis
ALLGV

SEQ ID NO: 2346 - protein, 5 aa, Chlamydia trachomatis
LLGVQ

SEQ ID NO: 2347 - protein, 5 aa, Chlamydia trachomatis
LGVQK

SEQ ID NO: 2348 - protein, 5 aa, Chlamydia trachomatis
GVQKL

SEQ ID NO: 2349 - protein, 5 aa, Chlamydia trachomatis
VQKLP

SEQ ID NO: 2350 - protein, 5 aa, Chlamydia trachomatis
QKLPE

SEQ ID NO: 2351 - protein, 5 aa, Chlamydia trachomatis
KLPEE

SEQ ID NO: 2352 - protein, 5 aa, Chlamydia trachomatis
LPEEQ

SEQ ID NO: 2353 - protein, 5 aa, Chlamydia trachomatis
PEEQK

SEQ ID NO: 2354 - protein, 5 aa, Chlamydia trachomatis
EEQKQ

SEQ ID NO: 2355 - protein, 5 aa, Chlamydia trachomatis
EQKQE

SEQ ID NO: 2356 - protein, 5 aa, Chlamydia trachomatis
QKQES

SEQ ID NO: 2357 - protein, 5 aa, Chlamydia trachomatis
KQESL

SEQ ID NO: 2358 - protein, 5 aa, Chlamydia trachomatis
QESLK

SEQ ID NO: 2359 - protein, 5 aa, Chlamydia trachomatis
ESLKS

SEQ ID NO: 2360 - protein, 5 aa, Chlamydia trachomatis
SLKSA

SEQ ID NO: 2361 - protein, 5 aa, Chlamydia trachomatis
LKSAV

SEQ ID NO: 2362 - protein, 5 aa, Chlamydia trachomatis
KSAVK

SEQ ID NO: 2363 - protein, 5 aa, Chlamydia trachomatis
SAVKA

SEQ ID NO: 2364 - protein, 5 aa, Chlamydia trachomatis
AVKAL

SEQ ID NO: 2365 - protein, 5 aa, Chlamydia trachomatis
VKALR

SEQ ID NO: 2366 - protein, 5 aa, Chlamydia trachomatis
KALRA

SEQ ID NO: 2367 - protein, 5 aa, Chlamydia trachomatis
ALRAD

SEQ ID NO: 2368 - protein, 5 aa, Chlamydia trachomatis
LRADA

SEQ ID NO: 2369 - protein, 5 aa, Chlamydia trachomatis
RADAK

SEQ ID NO: 2370 - protein, 5 aa, Chlamydia trachomatis
ADAKV

SEQ ID NO: 2371 - protein, 5 aa, Chlamydia trachomatis
DAKVL

SEQ ID NO: 2372 - protein, 5 aa, Chlamydia trachomatis
AKVLN

SEQ ID NO: 2373 - protein, 5 aa, Chlamydia trachomatis
KVLNK

SEQ ID NO: 2374 - protein, 5 aa, Chlamydia trachomatis
VLNKK

SEQ ID NO: 2375 - protein, 5 aa, Chlamydia trachomatis
LNKKF

SEQ ID NO: 2376 - protein, 5 aa, Chlamydia trachomatis
NKKFK

SEQ ID NO: 2377 - protein, 5 aa, Chlamydia trachomatis
KKFKK

SEQ ID NO: 2378 - protein, 5 aa, Chlamydia trachomatis
KFKKL

SEQ ID NO: 2379 - protein, 5 aa, Chlamydia trachomatis
FKKLP

SEQ ID NO: 2380 - protein, 5 aa, Chlamydia trachomatis
KKLPE

SEQ ID NO: 2381 - protein, 5 aa, Chlamydia trachomatis
KLPES

SEQ ID NO: 2382 - protein, 5 aa, Chlamydia trachomatis
LPESY

SEQ ID NO: 2383 - protein, 5 aa, Chlamydia trachomatis
PESYQ

SEQ ID NO: 2384 - protein, 5 aa, Chlamydia trachomatis
ESYQP

SEQ ID NO: 2385 - protein, 5 aa, Chlamydia trachomatis
SYQPQ

SEQ ID NO: 2386 - protein, 5 aa, Chlamydia trachomatis
YQPQH

SEQ ID NO: 2387 - protein, 5 aa, Chlamydia trachomatis
QPQHS

SEQ ID NO: 2388 - protein, 5 aa, Chlamydia trachomatis
PQHSE

SEQ ID NO: 2389 - protein, 5 aa, Chlamydia trachomatis
QHSEV

SEQ ID NO: 2390 - protein, 5 aa, Chlamydia trachomatis
HSEVT

SEQ ID NO: 2391 - protein, 5 aa, Chlamydia trachomatis
SEVTG

SEQ ID NO: 2392 - protein, 5 aa, Chlamydia trachomatis
EVTGV

SEQ ID NO: 2393 - protein, 5 aa, Chlamydia trachomatis
VTGVQ

SEQ ID NO: 2394 - protein, 5 aa, Chlamydia trachomatis
TGVQG

SEQ ID NO: 2395 - protein, 5 aa, Chlamydia trachomatis
GVQGV

SEQ ID NO: 2396 - protein, 5 aa, Chlamydia trachomatis
VQGVT

SEQ ID NO: 2397 - protein, 5 aa, Chlamydia trachomatis
QGVTE

SEQ ID NO: 2398 - protein, 5 aa, Chlamydia trachomatis
GVTEQ

SEQ ID NO: 2399 - protein, 5 aa, Chlamydia trachomatis
VTEQE

SEQ ID NO: 2400 - protein, 5 aa, Chlamydia trachomatis
TEQES

SEQ ID NO: 2401 - protein, 5 aa, Chlamydia trachomatis
EQESR

SEQ ID NO: 2402 - protein, 5 aa, Chlamydia trachomatis
QESRD

SEQ ID NO: 2403 - protein, 5 aa, Chlamydia trachomatis
ESRDD

SEQ ID NO: 2404 - protein, 5 aa, Chlamydia trachomatis
SRDDV

SEQ ID NO: 2405 - protein, 5 aa, Chlamydia trachomatis
RDDVL

SEQ ID NO: 2406 - protein, 5 aa, Chlamydia trachomatis
DDVLV

SEQ ID NO: 2407 - protein, 5 aa, Chlamydia trachomatis
DVLVA

SEQ ID NO: 2408 - protein, 5 aa, Chlamydia trachomatis
VLVAQ

SEQ ID NO: 2409 - protein, 5 aa, Chlamydia trachomatis
LVAQD

SEQ ID NO: 2410 - protein, 5 aa, Chlamydia trachomatis
VAQDM

SEQ ID NO: 2411 - protein, 5 aa, Chlamydia trachomatis
AQDMA

SEQ ID NO: 2412 - protein, 5 aa, Chlamydia trachomatis
QDMAA

SEQ ID NO: 2413 - protein, 5 aa, Chlamydia trachomatis
DMAAI

SEQ ID NO: 2414 - protein, 5 aa, Chlamydia trachomatis
MAAIE

SEQ ID NO: 2415 - protein, 5 aa, Chlamydia trachomatis
AAIEE

SEQ ID NO: 2416 - protein, 5 aa, Chlamydia trachomatis
AIEEL

SEQ ID NO: 2417 - protein, 5 aa, Chlamydia trachomatis
IEELQ

SEQ ID NO: 2418 - protein, 5 aa, Chlamydia trachomatis
EELQD

SEQ ID NO: 2419 - protein, 5 aa, Chlamydia trachomatis
ELQDQ

SEQ ID NO: 2420 - protein, 5 aa, Chlamydia trachomatis
LQDQY

SEQ ID NO: 2421 - protein, 5 aa, Chlamydia trachomatis
QDQYH

SEQ ID NO: 2422 - protein, 5 aa, Chlamydia trachomatis
DQYHA

SEQ ID NO: 2423 - protein, 5 aa, Chlamydia trachomatis
QYHAA

SEQ ID NO: 2424 - protein, 5 aa, Chlamydia trachomatis
YHAAC

SEQ ID NO: 2425 - protein, 5 aa, Chlamydia trachomatis
HAACL

SEQ ID NO: 2426 - protein, 5 aa, Chlamydia trachomatis
AACLQ

SEQ ID NO: 2427 - protein, 5 aa, Chlamydia trachomatis
ACLQF

SEQ ID NO: 2428 - protein, 5 aa, Chlamydia trachomatis
CLQFE

SEQ ID NO: 2429 - protein, 5 aa, Chlamydia trachomatis
LQFES

SEQ ID NO: 2430 - protein, 5 aa, Chlamydia trachomatis
QFESV

SEQ ID NO: 2431 - protein, 5 aa, Chlamydia trachomatis
FESVS

SEQ ID NO: 2432 - protein, 5 aa, Chlamydia trachomatis
ESVST

SEQ ID NO: 2433 - protein, 5 aa, Chlamydia trachomatis
SVSTR

SEQ ID NO: 2434 - protein, 5 aa, Chlamydia trachomatis
VSTRF

SEQ ID NO: 2435 - protein, 5 aa, Chlamydia trachomatis
STRFL

SEQ ID NO: 2436 - protein, 5 aa, Chlamydia trachomatis
TRFLA

SEQ ID NO: 2437 - protein, 5 aa, Chlamydia trachomatis
RFLAE

SEQ ID NO: 2438 - protein, 5 aa, Chlamydia trachomatis
FLAEQ

SEQ ID NO: 2439 - protein, 5 aa, Chlamydia trachomatis
LAEQR

SEQ ID NO: 2440 - protein, 5 aa, Chlamydia trachomatis
AEQRK

SEQ ID NO: 2441 - protein, 5 aa, Chlamydia trachomatis
EQRKA

SEQ ID NO: 2442 - protein, 5 aa, Chlamydia trachomatis
QRKAK

SEQ ID NO: 2443 - protein, 5 aa, Chlamydia trachomatis
RKAKF

SEQ ID NO: 2444 - protein, 5 aa, Chlamydia trachomatis
KAKFL

SEQ ID NO: 2445 - protein, 5 aa, Chlamydia trachomatis
AKFLE

SEQ ID NO: 2446 - protein, 5 aa, Chlamydia trachomatis
KFLEE

SEQ ID NO: 2447 - protein, 5 aa, Chlamydia trachomatis
FLEEL

SEQ ID NO: 2448 - protein, 5 aa, Chlamydia trachomatis
LEELL

SEQ ID NO: 2449 - protein, 5 aa, Chlamydia trachomatis
EELLV

SEQ ID NO: 2450 - protein, 5 aa, Chlamydia trachomatis
ELLVQ

SEQ ID NO: 2451 - protein, 5 aa, Chlamydia trachomatis
LLVQK

SEQ ID NO: 2452 - protein, 5 aa, Chlamydia trachomatis
LVQKR

SEQ ID NO: 2453 - protein, 5 aa, Chlamydia trachomatis
VQKRR

SEQ ID NO: 2454 - protein, 5 aa, Chlamydia trachomatis
QKRRD

SEQ ID NO: 2455 - protein, 5 aa, Chlamydia trachomatis
KRRDV

SEQ ID NO: 2456 - protein, 5 aa, Chlamydia trachomatis
RRDVS

SEQ ID NO: 2457 - protein, 5 aa, Chlamydia trachomatis
RDVSH

SEQ ID NO: 2458 - protein, 5 aa, Chlamydia trachomatis
DVSHL

SEQ ID NO: 2459 - protein, 5 aa, Chlamydia trachomatis
VSHLS

SEQ ID NO: 2460 - protein, 5 aa, Chlamydia trachomatis
SHLSH

SEQ ID NO: 2461 - protein, 5 aa, Chlamydia trachomatis
HLSHQ

SEQ ID NO: 2462 - protein, 5 aa, Chlamydia trachomatis
LSHQE

SEQ ID NO: 2463 - protein, 5 aa, Chlamydia trachomatis
SHQEA

SEQ ID NO: 2464 - protein, 5 aa, Chlamydia trachomatis
HQEAH

SEQ ID NO: 2465 - protein, 5 aa, Chlamydia trachomatis
QEAHY

SEQ ID NO: 2466 - protein, 5 aa, Chlamydia trachomatis
EAHYT

SEQ ID NO: 2467 - protein, 5 aa, Chlamydia trachomatis
AHYTQ

SEQ ID NO: 2468 - protein, 5 aa, Chlamydia trachomatis
HYTQV

SEQ ID NO: 2469 - protein, 5 aa, Chlamydia trachomatis
YTQVV

SEQ ID NO: 2470 - protein, 5 aa, Chlamydia trachomatis
TQVVS

SEQ ID NO: 2471 - protein, 5 aa, Chlamydia trachomatis
QVVSH

SEQ ID NO: 2472 - protein, 5 aa, Chlamydia trachomatis
VVSHL

SEQ ID NO: 2473 - protein, 5 aa, Chlamydia trachomatis
VSHLK

SEQ ID NO: 2474 - protein, 5 aa, Chlamydia trachomatis
SHLKE

SEQ ID NO: 2475 - protein, 5 aa, Chlamydia trachomatis
HLKEL

SEQ ID NO: 2476 - protein, 5 aa, Chlamydia trachomatis
LKELI

SEQ ID NO: 2477 - protein, 5 aa, Chlamydia trachomatis
KELIS

SEQ ID NO: 2478 - protein, 5 aa, Chlamydia trachomatis
ELISM

SEQ ID NO: 2479 - protein, 5 aa, Chlamydia trachomatis
LISMR

SEQ ID NO: 2480 - protein, 5 aa, Chlamydia trachomatis
ISMRK

SEQ ID NO: 2481 - protein, 5 aa, Chlamydia trachomatis
SMRKG

SEQ ID NO: 2482 - protein, 5 aa, Chlamydia trachomatis
MRKGA

SEQ ID NO: 2483 - protein, 5 aa, Chlamydia trachomatis
RKGAS

SEQ ID NO: 2484 - protein, 5 aa, Chlamydia trachomatis
KGAST

SEQ ID NO: 2485 - protein, 5 aa, Chlamydia trachomatis
GASTQ

SEQ ID NO: 2486 - protein, 5 aa, Chlamydia trachomatis
ASTQH

SEQ ID NO: 2487 - protein, 5 aa, Chlamydia trachomatis
STQHA

SEQ ID NO: 2488 - protein, 5 aa, Chlamydia trachomatis
TQHAS

SEQ ID NO: 2489 - protein, 5 aa, Chlamydia trachomatis
QHASK

SEQ ID NO: 2490 - protein, 5 aa, Chlamydia trachomatis
HASKE

SEQ ID NO: 2491 - protein, 5 aa, Chlamydia trachomatis
ASKEE

SEQ ID NO: 2492 - protein, 5 aa, Chlamydia trachomatis
SKEEI

SEQ ID NO: 2493 - protein, 5 aa, Chlamydia trachomatis
KEEIS

SEQ ID NO: 2494 - protein, 5 aa, Chlamydia trachomatis
EEIST

SEQ ID NO: 2495 - protein, 5 aa, Chlamydia trachomatis
EISTK

SEQ ID NO: 2496 - protein, 5 aa, Chlamydia trachomatis
ISTKM

SEQ ID NO: 2497 - protein, 5 aa, Chlamydia trachomatis
STKMR

SEQ ID NO: 2498 - protein, 5 aa, Chlamydia trachomatis
TKMRE

SEQ ID NO: 2499 - protein, 5 aa, Chlamydia trachomatis
KMREL

SEQ ID NO: 2500 - protein, 5 aa, Chlamydia trachomatis
MRELL

SEQ ID NO: 2501 - protein, 5 aa, Chlamydia trachomatis
RELLS

SEQ ID NO: 2502 - protein, 5 aa, Chlamydia trachomatis
ELLSL

SEQ ID NO: 2503 - protein, 5 aa, Chlamydia trachomatis
LLSLD

SEQ ID NO: 2504 - protein, 5 aa, Chlamydia trachomatis
LSLDD

SEQ ID NO: 2505 - protein, 5 aa, Chlamydia trachomatis
SLDDQ

SEQ ID NO: 2506 - protein, 5 aa, Chlamydia trachomatis
LDDQL

SEQ ID NO: 2507 - protein, 5 aa, Chlamydia trachomatis
DDQLL

SEQ ID NO: 2508 - protein, 5 aa, Chlamydia trachomatis
DQLLK

SEQ ID NO: 2509 - protein, 5 aa, Chlamydia trachomatis
QLLKA

SEQ ID NO: 2510 - protein, 5 aa, Chlamydia trachomatis
LLKAH

SEQ ID NO: 2511 - protein, 5 aa, Chlamydia trachomatis
LKAHT

SEQ ID NO: 2512 - protein, 5 aa, Chlamydia trachomatis
KAHTA

SEQ ID NO: 2513 - protein, 5 aa, Chlamydia trachomatis
AHTAQ

SEQ ID NO: 2514 - protein, 5 aa, Chlamydia trachomatis
HTAQD

SEQ ID NO: 2515 - protein, 5 aa, Chlamydia trachomatis
TAQDV

SEQ ID NO: 2516 - protein, 5 aa, Chlamydia trachomatis
AQDVN

SEQ ID NO: 2517 - protein, 5 aa, Chlamydia trachomatis
QDVNR

SEQ ID NO: 2518 - protein, 5 aa, Chlamydia trachomatis
DVNRD

SEQ ID NO: 2519 - protein, 5 aa, Chlamydia trachomatis
VNRDN

SEQ ID NO: 2520 - protein, 5 aa, Chlamydia trachomatis
NRDNS

SEQ ID NO: 2521 - protein, 5 aa, Chlamydia trachomatis
RDNSI

SEQ ID NO: 2522 - protein, 5 aa, Chlamydia trachomatis
DNSIN

SEQ ID NO: 2523 - protein, 5 aa, Chlamydia trachomatis
NSING

SEQ ID NO: 2524 - protein, 5 aa, Chlamydia trachomatis
SINGQ

SEQ ID NO: 2525 - protein, 5 aa, Chlamydia trachomatis
INGQL

SEQ ID NO: 2526 - protein, 5 aa, Chlamydia trachomatis
NGQLQ

SEQ ID NO: 2527 - protein, 5 aa, Chlamydia trachomatis
GQLQQ

SEQ ID NO: 2528 - protein, 5 aa, Chlamydia trachomatis
QLQQQ

SEQ ID NO: 2529 - protein, 5 aa, Chlamydia trachomatis
LQQQF

SEQ ID NO: 2530 - protein, 5 aa, Chlamydia trachomatis
QQQFK

SEQ ID NO: 2531 - protein, 5 aa, Chlamydia trachomatis
QQFKK

SEQ ID NO: 2532 - protein, 5 aa, Chlamydia trachomatis
QFKKL

SEQ ID NO: 2533 - protein, 5 aa, Chlamydia trachomatis
FKKLS

SEQ ID NO: 2534 - protein, 5 aa, Chlamydia trachomatis
KKLSE

SEQ ID NO: 2535 - protein, 5 aa, Chlamydia trachomatis
KLSEE

SEQ ID NO: 2536 - protein, 5 aa, Chlamydia trachomatis
LSEEG

SEQ ID NO: 2537 - protein, 5 aa, Chlamydia trachomatis
SEEGS

SEQ ID NO: 2538 - protein, 5 aa, Chlamydia trachomatis
EEGSL

SEQ ID NO: 2539 - protein, 5 aa, Chlamydia trachomatis
EGSLQ

SEQ ID NO: 2540 - protein, 5 aa, Chlamydia trachomatis
GSLQK

SEQ ID NO: 2541 - protein, 5 aa, Chlamydia trachomatis
SLQKV

SEQ ID NO: 2542 - protein, 5 aa, Chlamydia trachomatis
LQKVK

SEQ ID NO: 2543 - protein, 5 aa, Chlamydia trachomatis
QKVKA

SEQ ID NO: 2544 - protein, 5 aa, Chlamydia trachomatis
KVKAL

SEQ ID NO: 2545 - protein, 5 aa, Chlamydia trachomatis
VKALL

SEQ ID NO: 2546 - protein, 5 aa, Chlamydia trachomatis
KALLE

SEQ ID NO: 2547 - protein, 5 aa, Chlamydia trachomatis
ALLEL

SEQ ID NO: 2548 - protein, 5 aa, Chlamydia trachomatis
LLELN

SEQ ID NO: 2549 - protein, 5 aa, Chlamydia trachomatis
LELNM

SEQ ID NO: 2550 - protein, 5 aa, Chlamydia trachomatis
ELNMC

SEQ ID NO: 2551 - protein, 5 aa, Chlamydia trachomatis
LNMCL

SEQ ID NO: 2552 - protein, 5 aa, Chlamydia trachomatis
NMCLG

SEQ ID NO: 2553 - protein, 5 aa, Chlamydia trachomatis
MCLGN

SEQ ID NO: 2554 - protein, 5 aa, Chlamydia trachomatis
CLGNA

SEQ ID NO: 2555 - protein, 5 aa, Chlamydia trachomatis
LGNAG

SEQ ID NO: 2556 - protein, 5 aa, Chlamydia trachomatis
GNAGQ

SEQ ID NO: 2557 - protein, 5 aa, Chlamydia trachomatis
NAGQT

SEQ ID NO: 2558 - protein, 5 aa, Chlamydia trachomatis
AGQTL

SEQ ID NO: 2559 - protein, 5 aa, Chlamydia trachomatis
GQTLY

SEQ ID NO: 2560 - protein, 5 aa, Chlamydia trachomatis
QTLYH

SEQ ID NO: 2561 - protein, 5 aa, Chlamydia trachomatis
TLYHS

SEQ ID NO: 2562 - protein, 5 aa, Chlamydia trachomatis
LYHSR

SEQ ID NO: 2563 - protein, 5 aa, Chlamydia trachomatis
YHSRL

SEQ ID NO: 2564 - protein, 5 aa, Chlamydia trachomatis
HSRLK

SEQ ID NO: 2565 - protein, 5 aa, Chlamydia trachomatis
SRLKR

SEQ ID NO: 2566 - protein, 5 aa, Chlamydia trachomatis
RLKRE

SEQ ID NO: 2567 - protein, 5 aa, Chlamydia trachomatis
LKREV

SEQ ID NO: 2568 - protein, 5 aa, Chlamydia trachomatis
KREVF

SEQ ID NO: 2569 - protein, 5 aa, Chlamydia trachomatis
REVFE

SEQ ID NO: 2570 - protein, 5 aa, Chlamydia trachomatis
EVFEA

SEQ ID NO: 2571 - protein, 5 aa, Chlamydia trachomatis
VFEAS

SEQ ID NO: 2572 - protein, 5 aa, Chlamydia trachomatis
FEASL

SEQ ID NO: 2573 - protein, 5 aa, Chlamydia trachomatis
EASLS

SEQ ID NO: 2574 - protein, 5 aa, Chlamydia trachomatis
ASLSG

SEQ ID NO: 2575 - protein, 5 aa, Chlamydia trachomatis
SLSGT

SEQ ID NO: 2576 - protein, 5 aa, Chlamydia trachomatis
LSGTS

SEQ ID NO: 2577 - protein, 5 aa, Chlamydia trachomatis
SGTSR

SEQ ID NO: 2578 - protein, 5 aa, Chlamydia trachomatis
GTSRQ

SEQ ID NO: 2579 - protein, 5 aa, Chlamydia trachomatis
TSRQL

SEQ ID NO: 2580 - protein, 5 aa, Chlamydia trachomatis
SRQLL

SEQ ID NO: 2581 - protein, 5 aa, Chlamydia trachomatis
RQLLQ

SEQ ID NO: 2582 - protein, 5 aa, Chlamydia trachomatis
QLLQY

SEQ ID NO: 2583 - protein, 5 aa, Chlamydia trachomatis
LLQYG

SEQ ID NO: 2584 - protein, 5 aa, Chlamydia trachomatis
LQYGE

SEQ ID NO: 2585 - protein, 5 aa, Chlamydia trachomatis
QYGED

SEQ ID NO: 2586 - protein, 5 aa, Chlamydia trachomatis
YGEDL

SEQ ID NO: 2587 - protein, 5 aa, Chlamydia trachomatis
GEDLF

SEQ ID NO: 2588 - protein, 5 aa, Chlamydia trachomatis
EDLFA

SEQ ID NO: 2589 - protein, 5 aa, Chlamydia trachomatis
DLFAS

SEQ ID NO: 2590 - protein, 5 aa, Chlamydia trachomatis
LFASY

SEQ ID NO: 2591 - protein, 5 aa, Chlamydia trachomatis
FASYD

SEQ ID NO: 2592 - protein, 5 aa, Chlamydia trachomatis
ASYDG

SEQ ID NO: 2593 - protein, 5 aa, Chlamydia trachomatis
SYDGS

SEQ ID NO: 2594 - protein, 5 aa, Chlamydia trachomatis
YDGSD

SEQ ID NO: 2595 - protein, 5 aa, Chlamydia trachomatis
DGSDR

SEQ ID NO: 2596 - protein, 5 aa, Chlamydia trachomatis
GSDRS

SEQ ID NO: 2597 - protein, 5 aa, Chlamydia trachomatis
SDRSA

SEQ ID NO: 2598 - protein, 5 aa, Chlamydia trachomatis
DRSAL

SEQ ID NO: 2599 - protein, 5 aa, Chlamydia trachomatis
RSALL

SEQ ID NO: 2600 - protein, 5 aa, Chlamydia trachomatis
SALLR

SEQ ID NO: 2601 - protein, 5 aa, Chlamydia trachomatis
ALLRF

SEQ ID NO: 2602 - protein, 5 aa, Chlamydia trachomatis
LLRFV

SEQ ID NO: 2603 - protein, 5 aa, Chlamydia trachomatis
LRFVL

SEQ ID NO: 2604 - protein, 5 aa, Chlamydia trachomatis
RFVLG

SEQ ID NO: 2605 - protein, 5 aa, Chlamydia trachomatis
FVLGS

SEQ ID NO: 2606 - protein, 5 aa, Chlamydia trachomatis
VLGSG

SEQ ID NO: 2607 - protein, 5 aa, Chlamydia trachomatis
LGSGY

SEQ ID NO: 2608 - protein, 5 aa, Chlamydia trachomatis
GSGYE

SEQ ID NO: 2609 - protein, 5 aa, Chlamydia trachomatis
SGYEM

SEQ ID NO: 2610 - protein, 5 aa, Chlamydia trachomatis
GYEMI

SEQ ID NO: 2611 - protein, 5 aa, Chlamydia trachomatis
YEMIS

SEQ ID NO: 2612 - protein, 5 aa, Chlamydia trachomatis
EMISE

SEQ ID NO: 2613 - protein, 5 aa, Chlamydia trachomatis
MISEA

SEQ ID NO: 2614 - protein, 5 aa, Chlamydia trachomatis
ISEAS

SEQ ID NO: 2615 - protein, 5 aa, Chlamydia trachomatis
SEASS

SEQ ID NO: 2616 - protein, 5 aa, Chlamydia trachomatis
EASSE

SEQ ID NO: 2617 - protein, 5 aa, Chlamydia trachomatis
ASSEL

SEQ ID NO: 2618 - protein, 5 aa, Chlamydia trachomatis
SSELK

SEQ ID NO: 2619 - protein, 5 aa, Chlamydia trachomatis
SELKS

SEQ ID NO: 2620 - protein, 5 aa, Chlamydia trachomatis
ELKSL

SEQ ID NO: 2621 - protein, 5 aa, Chlamydia trachomatis
LKSLR

SEQ ID NO: 2622 - protein, 5 aa, Chlamydia trachomatis
KSLRK

SEQ ID NO: 2623 - protein, 5 aa, Chlamydia trachomatis
SLRKR

SEQ ID NO: 2624 - protein, 5 aa, Chlamydia trachomatis
LRKRW

SEQ ID NO: 2625 - protein, 5 aa, Chlamydia trachomatis
RKRWK

SEQ ID NO: 2626 - protein, 5 aa, Chlamydia trachomatis
KRWKR

SEQ ID NO: 2627 - protein, 5 aa, Chlamydia trachomatis
RWKRS

SEQ ID NO: 2628 - protein, 5 aa, Chlamydia trachomatis
WKRSA

SEQ ID NO: 2629 - protein, 5 aa, Chlamydia trachomatis
KRSAS

SEQ ID NO: 2630 - protein, 5 aa, Chlamydia trachomatis
RSASQ

SEQ ID NO: 2631 - protein, 5 aa, Chlamydia trachomatis
SASQA

SEQ ID NO: 2632 - protein, 5 aa, Chlamydia trachomatis
ASQAA

SEQ ID NO: 2633 - protein, 5 aa, Chlamydia trachomatis
SQAAI

SEQ ID NO: 2634 - protein, 5 aa, Chlamydia trachomatis
QAAIA

SEQ ID NO: 2635 - protein, 5 aa, Chlamydia trachomatis
AAIAP

SEQ ID NO: 2636 - protein, 5 aa, Chlamydia trachomatis
AIAPE

SEQ ID NO: 2637 - protein, 5 aa, Chlamydia trachomatis
IAPED

SEQ ID NO: 2638 - protein, 5 aa, Chlamydia trachomatis
APEDY

SEQ ID NO: 2639 - protein, 5 aa, Chlamydia trachomatis
PEDYE

SEQ ID NO: 2640 - protein, 5 aa, Chlamydia trachomatis
EDYEK

SEQ ID NO: 2641 - protein, 5 aa, Chlamydia trachomatis
DYEKV

SEQ ID NO: 2642 - protein, 5 aa, Chlamydia trachomatis
YEKVC

SEQ ID NO: 2643 - protein, 5 aa, Chlamydia trachomatis
EKVCR

SEQ ID NO: 2644 - protein, 5 aa, Chlamydia trachomatis
KVCRV

SEQ ID NO: 2645 - protein, 5 aa, Chlamydia trachomatis
VCRVL

SEQ ID NO: 2646 - protein, 5 aa, Chlamydia trachomatis
CRVLE

SEQ ID NO: 2647 - protein, 5 aa, Chlamydia trachomatis
RVLER

SEQ ID NO: 2648 - protein, 5 aa, Chlamydia trachomatis
VLERF

SEQ ID NO: 2649 - protein, 5 aa, Chlamydia trachomatis
LERFL

SEQ ID NO: 2650 - protein, 5 aa, Chlamydia trachomatis
ERFLK

SEQ ID NO: 2651 - protein, 5 aa, Chlamydia trachomatis
RFLKA

SEQ ID NO: 2652 - protein, 5 aa, Chlamydia trachomatis
FLKAR

SEQ ID NO: 2653 - protein, 5 aa, Chlamydia trachomatis
LKARD

SEQ ID NO: 2654 - protein, 5 aa, Chlamydia trachomatis
KARDS

SEQ ID NO: 2655 - protein, 5 aa, Chlamydia trachomatis
ARDSL

SEQ ID NO: 2656 - protein, 5 aa, Chlamydia trachomatis
RDSLR

SEQ ID NO: 2657 - protein, 5 aa, Chlamydia trachomatis
DSLRP

SEQ ID NO: 2658 - protein, 5 aa, Chlamydia trachomatis
SLRPK

SEQ ID NO: 2659 - protein, 5 aa, Chlamydia trachomatis
LRPKL

SEQ ID NO: 2660 - protein, 5 aa, Chlamydia trachomatis
RPKLG

SEQ ID NO: 2661 - protein, 5 aa, Chlamydia trachomatis
PKLGL

SEQ ID NO: 2662 - protein, 5 aa, Chlamydia trachomatis
KLGLP

SEQ ID NO: 2663 - protein, 5 aa, Chlamydia trachomatis
LGLPL

SEQ ID NO: 2664 - protein, 5 aa, Chlamydia trachomatis
GLPLG

SEQ ID NO: 2665 - protein, 5 aa, Chlamydia trachomatis
LPLGK

SEQ ID NO: 2666 - protein, 5 aa, Chlamydia trachomatis
PLGKS

SEQ ID NO: 2667 - protein, 5 aa, Chlamydia trachomatis
LGKSS

SEQ ID NO: 2668 - protein, 5 aa, Chlamydia trachomatis
GKSSD

SEQ ID NO: 2669 - protein, 5 aa, Chlamydia trachomatis
KSSDA

SEQ ID NO: 2670 - protein, 5 aa, Chlamydia trachomatis
SSDAT

SEQ ID NO: 2671 - protein, 5 aa, Chlamydia trachomatis
SDATV

SEQ ID NO: 2672 - protein, 5 aa, Chlamydia trachomatis
DATVG

SEQ ID NO: 2673 - protein, 5 aa, Chlamydia trachomatis
ATVGL

SEQ ID NO: 2674 - protein, 5 aa, Chlamydia trachomatis
TVGLQ

SEQ ID NO: 2675 - protein, 5 aa, Chlamydia trachomatis
VGLQH

SEQ ID NO: 2676 - protein, 5 aa, Chlamydia trachomatis
GLQHQ

SEQ ID NO: 2677 - protein, 5 aa, Chlamydia trachomatis
LQHQI

SEQ ID NO: 2678 - protein, 5 aa, Chlamydia trachomatis
QHQIR

SEQ ID NO: 2679 - protein, 5 aa, Chlamydia trachomatis
HQIRD

SEQ ID NO: 2680 - protein, 5 aa, Chlamydia trachomatis
QIRDN

SEQ ID NO: 2681 - protein, 5 aa, Chlamydia trachomatis
IRDNQ

SEQ ID NO: 2682 - protein, 5 aa, Chlamydia trachomatis
RDNQR

SEQ ID NO: 2683 - protein, 5 aa, Chlamydia trachomatis
DNQRV

SEQ ID NO: 2684 - protein, 5 aa, Chlamydia trachomatis
NQRVK

SEQ ID NO: 2685 - protein, 5 aa, Chlamydia trachomatis
QRVKA

SEQ ID NO: 2686 - protein, 5 aa, Chlamydia trachomatis
RVKAR

SEQ ID NO: 2687 - protein, 5 aa, Chlamydia trachomatis
VKARV

SEQ ID NO: 2688 - protein, 5 aa, Chlamydia trachomatis
KARVT

SEQ ID NO: 2689 - protein, 5 aa, Chlamydia trachomatis
ARVTA

SEQ ID NO: 2690 - protein, 5 aa, Chlamydia trachomatis
RVTAC

SEQ ID NO: 2691 - protein, 5 aa, Chlamydia trachomatis
VTACY

SEQ ID NO: 2692 - protein, 5 aa, Chlamydia trachomatis
TACYQ

SEQ ID NO: 2693 - protein, 5 aa, Chlamydia trachomatis
ACYQE

SEQ ID NO: 2694 - protein, 5 aa, Chlamydia trachomatis
CYQES

SEQ ID NO: 2695 - protein, 5 aa, Chlamydia trachomatis
YQESC

SEQ ID NO: 2696 - protein, 5 aa, Chlamydia trachomatis
QESCR

SEQ ID NO: 2697 - protein, 5 aa, Chlamydia trachomatis
ESCRN

SEQ ID NO: 2698 - protein, 5 aa, Chlamydia trachomatis
SCRNV

SEQ ID NO: 2699 - protein, 5 aa, Chlamydia trachomatis
CRNVL

SEQ ID NO: 2700 - protein, 5 aa, Chlamydia trachomatis
RNVLQ

SEQ ID NO: 2701 - protein, 5 aa, Chlamydia trachomatis
NVLQH

SEQ ID NO: 2702 - protein, 5 aa, Chlamydia trachomatis
VLQHL

SEQ ID NO: 2703 - protein, 5 aa, Chlamydia trachomatis
LQHLE

SEQ ID NO: 2704 - protein, 5 aa, Chlamydia trachomatis
QHLED

SEQ ID NO: 2705 - protein, 5 aa, Chlamydia trachomatis
HLEDW

SEQ ID NO: 2706 - protein, 5 aa, Chlamydia trachomatis
LEDWV

SEQ ID NO: 2707 - protein, 5 aa, Chlamydia trachomatis
EDWVR

SEQ ID NO: 2708 - protein, 5 aa, Chlamydia trachomatis
DWVRK

SEQ ID NO: 2709 - protein, 5 aa, Chlamydia trachomatis
WVRKT

SEQ ID NO: 2710 - protein, 5 aa, Chlamydia trachomatis
VRKTR

SEQ ID NO: 2711 - protein, 5 aa, Chlamydia trachomatis
RKTRQ

SEQ ID NO: 2712 - protein, 5 aa, Chlamydia trachomatis
KTRQE

SEQ ID NO: 2713 - protein, 5 aa, Chlamydia trachomatis
TRQES

SEQ ID NO: 2714 - protein, 5 aa, Chlamydia trachomatis
RQESA

SEQ ID NO: 2715 - protein, 5 aa, Chlamydia trachomatis
QESAE

SEQ ID NO: 2716 - protein, 5 aa, Chlamydia trachomatis
ESAEC

SEQ ID NO: 2717 - protein, 5 aa, Chlamydia trachomatis
SAECQ

SEQ ID NO: 2718 - protein, 5 aa, Chlamydia trachomatis
AECQK

SEQ ID NO: 2719 - protein, 5 aa, Chlamydia trachomatis
ECQKV

SEQ ID NO: 2720 - protein, 5 aa, Chlamydia trachomatis
CQKVE

SEQ ID NO: 2721 - protein, 5 aa, Chlamydia trachomatis
QKVET

SEQ ID NO: 2722 - protein, 5 aa, Chlamydia trachomatis
KVETK

SEQ ID NO: 2723 - protein, 5 aa, Chlamydia trachomatis
VETKI

SEQ ID NO: 2724 - protein, 5 aa, Chlamydia trachomatis
ETKIR

SEQ ID NO: 2725 - protein, 5 aa, Chlamydia trachomatis
TKIRE

SEQ ID NO: 2726 - protein, 5 aa, Chlamydia trachomatis
KIREF

SEQ ID NO: 2727 - protein, 5 aa, Chlamydia trachomatis
IREFC

SEQ ID NO: 2728 - protein, 5 aa, Chlamydia trachomatis
REFCQ

SEQ ID NO: 2729 - protein, 5 aa, Chlamydia trachomatis
EFCQK

SEQ ID NO: 2730 - protein, 5 aa, Chlamydia trachomatis
FCQKA

SEQ ID NO: 2731 - protein, 5 aa, Chlamydia trachomatis
CQKAG

SEQ ID NO: 2732 - protein, 5 aa, Chlamydia trachomatis
QKAGS

SEQ ID NO: 2733 - protein, 5 aa, Chlamydia trachomatis
KAGSK

SEQ ID NO: 2734 - protein, 5 aa, Chlamydia trachomatis
AGSKE

SEQ ID NO: 2735 - protein, 5 aa, Chlamydia trachomatis
GSKEN

SEQ ID NO: 2736 - protein, 5 aa, Chlamydia trachomatis
SKENL

SEQ ID NO: 2737 - protein, 5 aa, Chlamydia trachomatis
KENLA

SEQ ID NO: 2738 - protein, 5 aa, Chlamydia trachomatis
ENLAE

SEQ ID NO: 2739 - protein, 5 aa, Chlamydia trachomatis
NLAES

SEQ ID NO: 2740 - protein, 5 aa, Chlamydia trachomatis
LAEST

SEQ ID NO: 2741 - protein, 5 aa, Chlamydia trachomatis
AESTE

SEQ ID NO: 2742 - protein, 5 aa, Chlamydia trachomatis
ESTEM

SEQ ID NO: 2743 - protein, 5 aa, Chlamydia trachomatis
STEML

SEQ ID NO: 2744 - protein, 5 aa, Chlamydia trachomatis
TEMLF

SEQ ID NO: 2745 - protein, 5 aa, Chlamydia trachomatis
EMLFS

SEQ ID NO: 2746 - protein, 5 aa, Chlamydia trachomatis
MLFSS

SEQ ID NO: 2747 - protein, 5 aa, Chlamydia trachomatis
LFSSL

SEQ ID NO: 2748 - protein, 5 aa, Chlamydia trachomatis
FSSLE

SEQ ID NO: 2749 - protein, 5 aa, Chlamydia trachomatis
SSLEE

SEQ ID NO: 2750 - protein, 5 aa, Chlamydia trachomatis
SLEED

SEQ ID NO: 2751 - protein, 5 aa, Chlamydia trachomatis
LEEDL

SEQ ID NO: 2752 - protein, 5 aa, Chlamydia trachomatis
EEDLN

SEQ ID NO: 2753 - protein, 5 aa, Chlamydia trachomatis
EDLNK

SEQ ID NO: 2754 - protein, 5 aa, Chlamydia trachomatis
DLNKI

SEQ ID NO: 2755 - protein, 5 aa, Chlamydia trachomatis
LNKIP

SEQ ID NO: 2756 - protein, 5 aa, Chlamydia trachomatis
NKIPL

SEQ ID NO: 2757 - protein, 5 aa, Chlamydia trachomatis
KIPLD

SEQ ID NO: 2758 - protein, 5 aa, Chlamydia trachomatis
IPLDV

SEQ ID NO: 2759 - protein, 5 aa, Chlamydia trachomatis
PLDVL

SEQ ID NO: 2760 - protein, 5 aa, Chlamydia trachomatis
LDVLR

SEQ ID NO: 2761 - protein, 5 aa, Chlamydia trachomatis
DVLRA

SEQ ID NO: 2762 - protein, 5 aa, Chlamydia trachomatis
VLRAI

SEQ ID NO: 2763 - protein, 5 aa, Chlamydia trachomatis
LRAIL

SEQ ID NO: 2764 - protein, 5 aa, Chlamydia trachomatis
RAILR

SEQ ID NO: 2765 - protein, 5 aa, Chlamydia trachomatis
AILRS

SEQ ID NO: 2766 - protein, 5 aa, Chlamydia trachomatis
ILRSL

SEQ ID NO: 2767 - protein, 5 aa, Chlamydia trachomatis
LRSLS

SEQ ID NO: 2768 - protein, 5 aa, Chlamydia trachomatis
RSLSS

SEQ ID NO: 2769 - protein, 5 aa, Chlamydia trachomatis
SLSSK

SEQ ID NO: 2770 - protein, 5 aa, Chlamydia trachomatis
LSSKV

SEQ ID NO: 2771 - protein, 5 aa, Chlamydia trachomatis
SSKVL

SEQ ID NO: 2772 - protein, 5 aa, Chlamydia trachomatis
SKVLH

SEQ ID NO: 2773 - protein, 5 aa, Chlamydia trachomatis
KVLHI

SEQ ID NO: 2774 - protein, 5 aa, Chlamydia trachomatis
VLHIR

SEQ ID NO: 2775 - protein, 5 aa, Chlamydia trachomatis
LHIRD

SEQ ID NO: 2776 - protein, 5 aa, Chlamydia trachomatis
HIRDQ

SEQ ID NO: 2777 - protein, 5 aa, Chlamydia trachomatis
IRDQK

SEQ ID NO: 2778 - protein, 5 aa, Chlamydia trachomatis
RDQKL

SEQ ID NO: 2779 - protein, 5 aa, Chlamydia trachomatis
DQKLE

SEQ ID NO: 2780 - protein, 5 aa, Chlamydia trachomatis
QKLEL

SEQ ID NO: 2781 - protein, 5 aa, Chlamydia trachomatis
KLELE

SEQ ID NO: 2782 - protein, 5 aa, Chlamydia trachomatis
LELEK

SEQ ID NO: 2783 - protein, 5 aa, Chlamydia trachomatis
ELEKL

SEQ ID NO: 2784 - protein, 5 aa, Chlamydia trachomatis
LEKLE

SEQ ID NO: 2785 - protein, 5 aa, Chlamydia trachomatis
EKLEE

SEQ ID NO: 2786 - protein, 5 aa, Chlamydia trachomatis
KLEEQ

SEQ ID NO: 2787 - protein, 5 aa, Chlamydia trachomatis
LEEQF

SEQ ID NO: 2788 - protein, 5 aa, Chlamydia trachomatis
EEQFA

SEQ ID NO: 2789 - protein, 5 aa, Chlamydia trachomatis
EQFAK

SEQ ID NO: 2790 - protein, 5 aa, Chlamydia trachomatis
QFAKT

SEQ ID NO: 2791 - protein, 5 aa, Chlamydia trachomatis
FAKTN

SEQ ID NO: 2792 - protein, 5 aa, Chlamydia trachomatis
AKTNA

SEQ ID NO: 2793 - protein, 5 aa, Chlamydia trachomatis
KTNAI

SEQ ID NO: 2794 - protein, 5 aa, Chlamydia trachomatis
TNAIV

SEQ ID NO: 2795 - protein, 5 aa, Chlamydia trachomatis
NAIVK

SEQ ID NO: 2796 - protein, 5 aa, Chlamydia trachomatis
AIVKA

SEQ ID NO: 2797 - protein, 5 aa, Chlamydia trachomatis
IVKAK

SEQ ID NO: 2798 - protein, 5 aa, Chlamydia trachomatis
VKAKE

SEQ ID NO: 2799 - protein, 5 aa, Chlamydia trachomatis
KAKEA

SEQ ID NO: 2800 - protein, 5 aa, Chlamydia trachomatis
AKEAE

SEQ ID NO: 2801 - protein, 5 aa, Chlamydia trachomatis
KEAEF

SEQ ID NO: 2802 - protein, 5 aa, Chlamydia trachomatis
EAEFE

SEQ ID NO: 2803 - protein, 5 aa, Chlamydia trachomatis
AEFEK

SEQ ID NO: 2804 - protein, 5 aa, Chlamydia trachomatis
EFEKN

SEQ ID NO: 2805 - protein, 5 aa, Chlamydia trachomatis
FEKNG

SEQ ID NO: 2806 - protein, 5 aa, Chlamydia trachomatis
EKNGE

SEQ ID NO: 2807 - protein, 5 aa, Chlamydia trachomatis
KNGEV

SEQ ID NO: 2808 - protein, 5 aa, Chlamydia trachomatis
NGEVW

SEQ ID NO: 2809 - protein, 5 aa, Chlamydia trachomatis
GEVWH

SEQ ID NO: 2810 - protein, 5 aa, Chlamydia trachomatis
EVWHN

SEQ ID NO: 2811 - protein, 5 aa, Chlamydia trachomatis
VWHNQ

SEQ ID NO: 2812 - protein, 5 aa, Chlamydia trachomatis
WHNQY

SEQ ID NO: 2813 - protein, 5 aa, Chlamydia trachomatis
HNQYQ

SEQ ID NO: 2814 - protein, 5 aa, Chlamydia trachomatis
NQYQM

SEQ ID NO: 2815 - protein, 5 aa, Chlamydia trachomatis
QYQML

SEQ ID NO: 2816 - protein, 5 aa, Chlamydia trachomatis
YQMLK

SEQ ID NO: 2817 - protein, 5 aa, Chlamydia trachomatis
QMLKS

SEQ ID NO: 2818 - protein, 5 aa, Chlamydia trachomatis
MLKSQ

SEQ ID NO: 2819 - protein, 5 aa, Chlamydia trachomatis
LKSQM

SEQ ID NO: 2820 - protein, 5 aa, Chlamydia trachomatis
KSQME

SEQ ID NO: 2821 - protein, 5 aa, Chlamydia trachomatis
SQMEK

SEQ ID NO: 2822 - protein, 5 aa, Chlamydia trachomatis
QMEKL

SEQ ID NO: 2823 - protein, 5 aa, Chlamydia trachomatis
MEKLE

SEQ ID NO: 2824 - protein, 5 aa, Chlamydia trachomatis
EKLES

SEQ ID NO: 2825 - protein, 5 aa, Chlamydia trachomatis
KLESQ

SEQ ID NO: 2826 - protein, 5 aa, Chlamydia trachomatis
LESQK

SEQ ID NO: 2827 - protein, 5 aa, Chlamydia trachomatis
ESQKR

SEQ ID NO: 2828 - protein, 5 aa, Chlamydia trachomatis
SQKRR

SEQ ID NO: 2829 - protein, 5 aa, Chlamydia trachomatis
QKRRL

SEQ ID NO: 2830 - protein, 5 aa, Chlamydia trachomatis
KRRLT

SEQ ID NO: 2831 - protein, 5 aa, Chlamydia trachomatis
RRLTD

SEQ ID NO: 2832 - protein, 5 aa, Chlamydia trachomatis
RLTDK

SEQ ID NO: 2833 - protein, 5 aa, Chlamydia trachomatis
LTDKK

SEQ ID NO: 2834 - protein, 5 aa, Chlamydia trachomatis
TDKKE

SEQ ID NO: 2835 - protein, 5 aa, Chlamydia trachomatis
MVAKN

SEQ ID NO: 2836 - protein, 5 aa, Chlamydia trachomatis
VAKNI

SEQ ID NO: 2837 - protein, 5 aa, Chlamydia trachomatis
AKNIK

SEQ ID NO: 2838 - protein, 5 aa, Chlamydia trachomatis
KNIKY

SEQ ID NO: 2839 - protein, 5 aa, Chlamydia trachomatis
NIKYN

SEQ ID NO: 2840 - protein, 5 aa, Chlamydia trachomatis
IKYNE

SEQ ID NO: 2841 - protein, 5 aa, Chlamydia trachomatis
KYNEE

SEQ ID NO: 2842 - protein, 5 aa, Chlamydia trachomatis
YNEEA

SEQ ID NO: 2843 - protein, 5 aa, Chlamydia trachomatis
NEEAR

SEQ ID NO: 2844 - protein, 5 aa, Chlamydia trachomatis
EEARK

SEQ ID NO: 2845 - protein, 5 aa, Chlamydia trachomatis
EARKK

SEQ ID NO: 2846 - protein, 5 aa, Chlamydia trachomatis
ARKKI

SEQ ID NO: 2847 - protein, 5 aa, Chlamydia trachomatis
RKKIQ

SEQ ID NO: 2848 - protein, 5 aa, Chlamydia trachomatis
KKIQK

SEQ ID NO: 2849 - protein, 5 aa, Chlamydia trachomatis
KIQKG

SEQ ID NO: 2850 - protein, 5 aa, Chlamydia trachomatis
IQKGV

SEQ ID NO: 2851 - protein, 5 aa, Chlamydia trachomatis
QKGVK

SEQ ID NO: 2852 - protein, 5 aa, Chlamydia trachomatis
KGVKT

SEQ ID NO: 2853 - protein, 5 aa, Chlamydia trachomatis
GVKTL

SEQ ID NO: 2854 - protein, 5 aa, Chlamydia trachomatis
VKTLA

SEQ ID NO: 2855 - protein, 5 aa, Chlamydia trachomatis
KTLAE

SEQ ID NO: 2856 - protein, 5 aa, Chlamydia trachomatis
TLAEA

SEQ ID NO: 2857 - protein, 5 aa, Chlamydia trachomatis
LAEAV

SEQ ID NO: 2858 - protein, 5 aa, Chlamydia trachomatis
AEAVK

SEQ ID NO: 2859 - protein, 5 aa, Chlamydia trachomatis
EAVKV

SEQ ID NO: 2860 - protein, 5 aa, Chlamydia trachomatis
AVKVT

SEQ ID NO: 2861 - protein, 5 aa, Chlamydia trachomatis
VKVTL

SEQ ID NO: 2862 - protein, 5 aa, Chlamydia trachomatis
KVTLG

SEQ ID NO: 2863 - protein, 5 aa, Chlamydia trachomatis
VTLGP

SEQ ID NO: 2864 - protein, 5 aa, Chlamydia trachomatis
TLGPK

SEQ ID NO: 2865 - protein, 5 aa, Chlamydia trachomatis
LGPKG

SEQ ID NO: 2866 - protein, 5 aa, Chlamydia trachomatis
GPKGR

SEQ ID NO: 2867 - protein, 5 aa, Chlamydia trachomatis
PKGRH

SEQ ID NO: 2868 - protein, 5 aa, Chlamydia trachomatis
KGRHV

SEQ ID NO: 2869 - protein, 5 aa, Chlamydia trachomatis
GRHVV

SEQ ID NO: 2870 - protein, 5 aa, Chlamydia trachomatis
RHVVI

SEQ ID NO: 2871 - protein, 5 aa, Chlamydia trachomatis
HVVID

SEQ ID NO: 2872 - protein, 5 aa, Chlamydia trachomatis
VVIDK

SEQ ID NO: 2873 - protein, 5 aa, Chlamydia trachomatis
VIDKS

SEQ ID NO: 2874 - protein, 5 aa, Chlamydia trachomatis
IDKSF

SEQ ID NO: 2875 - protein, 5 aa, Chlamydia trachomatis
DKSFG

SEQ ID NO: 2876 - protein, 5 aa, Chlamydia trachomatis
KSFGS

SEQ ID NO: 2877 - protein, 5 aa, Chlamydia trachomatis
SFGSP

SEQ ID NO: 2878 - protein, 5 aa, Chlamydia trachomatis
FGSPQ

SEQ ID NO: 2879 - protein, 5 aa, Chlamydia trachomatis
GSPQV

SEQ ID NO: 2880 - protein, 5 aa, Chlamydia trachomatis
SPQVT

SEQ ID NO: 2881 - protein, 5 aa, Chlamydia trachomatis
PQVTK

SEQ ID NO: 2882 - protein, 5 aa, Chlamydia trachomatis
QVTKD

SEQ ID NO: 2883 - protein, 5 aa, Chlamydia trachomatis
VTKDG

SEQ ID NO: 2884 - protein, 5 aa, Chlamydia trachomatis
TKDGV

SEQ ID NO: 2885 - protein, 5 aa, Chlamydia trachomatis
KDGVT

SEQ ID NO: 2886 - protein, 5 aa, Chlamydia trachomatis
DGVTV

SEQ ID NO: 2887 - protein, 5 aa, Chlamydia trachomatis
GVTVA

SEQ ID NO: 2888 - protein, 5 aa, Chlamydia trachomatis
VTVAK

SEQ ID NO: 2889 - protein, 5 aa, Chlamydia trachomatis
TVAKE

SEQ ID NO: 2890 - protein, 5 aa, Chlamydia trachomatis
VAKEV

SEQ ID NO: 2891 - protein, 5 aa, Chlamydia trachomatis
AKEVE

SEQ ID NO: 2892 - protein, 5 aa, Chlamydia trachomatis
KEVEL

SEQ ID NO: 2893 - protein, 5 aa, Chlamydia trachomatis
EVELA

SEQ ID NO: 2894 - protein, 5 aa, Chlamydia trachomatis
VELAD

SEQ ID NO: 2895 - protein, 5 aa, Chlamydia trachomatis
ELADK

SEQ ID NO: 2896 - protein, 5 aa, Chlamydia trachomatis
LADKH

SEQ ID NO: 2897 - protein, 5 aa, Chlamydia trachomatis
ADKHE

SEQ ID NO: 2898 - protein, 5 aa, Chlamydia trachomatis
DKHEN

SEQ ID NO: 2899 - protein, 5 aa, Chlamydia trachomatis
KHENM

SEQ ID NO: 2900 - protein, 5 aa, Chlamydia trachomatis
HENMG

SEQ ID NO: 2901 - protein, 5 aa, Chlamydia trachomatis
ENMGA

SEQ ID NO: 2902 - protein, 5 aa, Chlamydia trachomatis
NMGAQ

SEQ ID NO: 2903 - protein, 5 aa, Chlamydia trachomatis
MGAQM

SEQ ID NO: 2904 - protein, 5 aa, Chlamydia trachomatis
GAQMV

SEQ ID NO: 2905 - protein, 5 aa, Chlamydia trachomatis
AQMVK

SEQ ID NO: 2906 - protein, 5 aa, Chlamydia trachomatis
QMVKE

SEQ ID NO: 2907 - protein, 5 aa, Chlamydia trachomatis
MVKEV

SEQ ID NO: 2908 - protein, 5 aa, Chlamydia trachomatis
VKEVA

SEQ ID NO: 2909 - protein, 5 aa, Chlamydia trachomatis
KEVAS

SEQ ID NO: 2910 - protein, 5 aa, Chlamydia trachomatis
EVASK

SEQ ID NO: 2911 - protein, 5 aa, Chlamydia trachomatis
VASKT

SEQ ID NO: 2912 - protein, 5 aa, Chlamydia trachomatis
ASKTA

SEQ ID NO: 2913 - protein, 5 aa, Chlamydia trachomatis
SKTAD

SEQ ID NO: 2914 - protein, 5 aa, Chlamydia trachomatis
KTADK

SEQ ID NO: 2915 - protein, 5 aa, Chlamydia trachomatis
TADKA

SEQ ID NO: 2916 - protein, 5 aa, Chlamydia trachomatis
ADKAG

SEQ ID NO: 2917 - protein, 5 aa, Chlamydia trachomatis
DKAGD

SEQ ID NO: 2918 - protein, 5 aa, Chlamydia trachomatis
KAGDG

SEQ ID NO: 2919 - protein, 5 aa, Chlamydia trachomatis
AGDGT

SEQ ID NO: 2920 - protein, 5 aa, Chlamydia trachomatis
GDGTT

SEQ ID NO: 2921 - protein, 5 aa, Chlamydia trachomatis
DGTTT

SEQ ID NO: 2922 - protein, 5 aa, Chlamydia trachomatis
GTTTA

SEQ ID NO: 2923 - protein, 5 aa, Chlamydia trachomatis
TTTAT

SEQ ID NO: 2924 - protein, 5 aa, Chlamydia trachomatis
TTATV

SEQ ID NO: 2925 - protein, 5 aa, Chlamydia trachomatis
TATVL

SEQ ID NO: 2926 - protein, 5 aa, Chlamydia trachomatis
ATVLA

SEQ ID NO: 2927 - protein, 5 aa, Chlamydia trachomatis
TVLAE

SEQ ID NO: 2928 - protein, 5 aa, Chlamydia trachomatis
VLAEA

SEQ ID NO: 2929 - protein, 5 aa, Chlamydia trachomatis
LAEAI

SEQ ID NO: 2930 - protein, 5 aa, Chlamydia trachomatis
AEAIY

SEQ ID NO: 2931 - protein, 5 aa, Chlamydia trachomatis
EAIYT

SEQ ID NO: 2932 - protein, 5 aa, Chlamydia trachomatis
AIYTE

SEQ ID NO: 2933 - protein, 5 aa, Chlamydia trachomatis
IYTEG

SEQ ID NO: 2934 - protein, 5 aa, Chlamydia trachomatis
YTEGL

SEQ ID NO: 2935 - protein, 5 aa, Chlamydia trachomatis
TEGLR

SEQ ID NO: 2936 - protein, 5 aa, Chlamydia trachomatis
EGLRN

SEQ ID NO: 2937 - protein, 5 aa, Chlamydia trachomatis
GLRNV

SEQ ID NO: 2938 - protein, 5 aa, Chlamydia trachomatis
LRNVT

SEQ ID NO: 2939 - protein, 5 aa, Chlamydia trachomatis
RNVTA

SEQ ID NO: 2940 - protein, 5 aa, Chlamydia trachomatis
NVTAG

SEQ ID NO: 2941 - protein, 5 aa, Chlamydia trachomatis
VTAGA

SEQ ID NO: 2942 - protein, 5 aa, Chlamydia trachomatis
TAGAN

SEQ ID NO: 2943 - protein, 5 aa, Chlamydia trachomatis
AGANP

SEQ ID NO: 2944 - protein, 5 aa, Chlamydia trachomatis
GANPM

SEQ ID NO: 2945 - protein, 5 aa, Chlamydia trachomatis
ANPMD

SEQ ID NO: 2946 - protein, 5 aa, Chlamydia trachomatis
NPMDL

SEQ ID NO: 2947 - protein, 5 aa, Chlamydia trachomatis
PMDLK

SEQ ID NO: 2948 - protein, 5 aa, Chlamydia trachomatis
MDLKR

SEQ ID NO: 2949 - protein, 5 aa, Chlamydia trachomatis
DLKRG

SEQ ID NO: 2950 - protein, 5 aa, Chlamydia trachomatis
LKRGI

SEQ ID NO: 2951 - protein, 5 aa, Chlamydia trachomatis
KRGID

SEQ ID NO: 2952 - protein, 5 aa, Chlamydia trachomatis
RGIDK

SEQ ID NO: 2953 - protein, 5 aa, Chlamydia trachomatis
GIDKA

SEQ ID NO: 2954 - protein, 5 aa, Chlamydia trachomatis
IDKAV

SEQ ID NO: 2955 - protein, 5 aa, Chlamydia trachomatis
DKAVK

SEQ ID NO: 2956 - protein, 5 aa, Chlamydia trachomatis
KAVKV

SEQ ID NO: 2957 - protein, 5 aa, Chlamydia trachomatis
AVKVV

SEQ ID NO: 2958 - protein, 5 aa, Chlamydia trachomatis
VKVVV

SEQ ID NO: 2959 - protein, 5 aa, Chlamydia trachomatis
KVVVD

SEQ ID NO: 2960 - protein, 5 aa, Chlamydia trachomatis
VVVDQ

SEQ ID NO: 2961 - protein, 5 aa, Chlamydia trachomatis
VVDQI

SEQ ID NO: 2962 - protein, 5 aa, Chlamydia trachomatis
VDQIR

SEQ ID NO: 2963 - protein, 5 aa, Chlamydia trachomatis
DQIRK

SEQ ID NO: 2964 - protein, 5 aa, Chlamydia trachomatis
QIRKI

SEQ ID NO: 2965 - protein, 5 aa, Chlamydia trachomatis
IRKIS

SEQ ID NO: 2966 - protein, 5 aa, Chlamydia trachomatis
RKISK

SEQ ID NO: 2967 - protein, 5 aa, Chlamydia trachomatis
KISKP

SEQ ID NO: 2968 - protein, 5 aa, Chlamydia trachomatis
ISKPV

SEQ ID NO: 2969 - protein, 5 aa, Chlamydia trachomatis
SKPVQ

SEQ ID NO: 2970 - protein, 5 aa, Chlamydia trachomatis
KPVQH

SEQ ID NO: 2971 - protein, 5 aa, Chlamydia trachomatis
PVQHH

SEQ ID NO: 2972 - protein, 5 aa, Chlamydia trachomatis
VQHHK

SEQ ID NO: 2973 - protein, 5 aa, Chlamydia trachomatis
QHHKE

SEQ ID NO: 2974 - protein, 5 aa, Chlamydia trachomatis
HHKEI

SEQ ID NO: 2975 - protein, 5 aa, Chlamydia trachomatis
HKEIA

SEQ ID NO: 2976 - protein, 5 aa, Chlamydia trachomatis
KEIAQ

SEQ ID NO: 2977 - protein, 5 aa, Chlamydia trachomatis
EIAQV

SEQ ID NO: 2978 - protein, 5 aa, Chlamydia trachomatis
IAQVA

SEQ ID NO: 2979 - protein, 5 aa, Chlamydia trachomatis
AQVAT

SEQ ID NO: 2980 - protein, 5 aa, Chlamydia trachomatis
QVATI

SEQ ID NO: 2981 - protein, 5 aa, Chlamydia trachomatis
VATIS

SEQ ID NO: 2982 - protein, 5 aa, Chlamydia trachomatis
ATISA

SEQ ID NO: 2983 - protein, 5 aa, Chlamydia trachomatis
TISAN

SEQ ID NO: 2984 - protein, 5 aa, Chlamydia trachomatis
ISANN

SEQ ID NO: 2985 - protein, 5 aa, Chlamydia trachomatis
SANND

SEQ ID NO: 2986 - protein, 5 aa, Chlamydia trachomatis
ANNDA

SEQ ID NO: 2987 - protein, 5 aa, Chlamydia trachomatis
NNDAE

SEQ ID NO: 2988 - protein, 5 aa, Chlamydia trachomatis
NDAEI

SEQ ID NO: 2989 - protein, 5 aa, Chlamydia trachomatis
DAEIG

SEQ ID NO: 2990 - protein, 5 aa, Chlamydia trachomatis
AEIGN

SEQ ID NO: 2991 - protein, 5 aa, Chlamydia trachomatis
EIGNL

SEQ ID NO: 2992 - protein, 5 aa, Chlamydia trachomatis
IGNLI

SEQ ID NO: 2993 - protein, 5 aa, Chlamydia trachomatis
GNLIA

SEQ ID NO: 2994 - protein, 5 aa, Chlamydia trachomatis
NLIAE

SEQ ID NO: 2995 - protein, 5 aa, Chlamydia trachomatis
LIAEA

SEQ ID NO: 2996 - protein, 5 aa, Chlamydia trachomatis
IAEAM

SEQ ID NO: 2997 - protein, 5 aa, Chlamydia trachomatis
AEAME

SEQ ID NO: 2998 - protein, 5 aa, Chlamydia trachomatis
EAMEK

SEQ ID NO: 2999 - protein, 5 aa, Chlamydia trachomatis
AMEKV

SEQ ID NO: 3000 - protein, 5 aa, Chlamydia trachomatis
MEKVG

SEQ ID NO: 3001 - protein, 5 aa, Chlamydia trachomatis
EKVGK

SEQ ID NO: 3002 - protein, 5 aa, Chlamydia trachomatis
KVGKN

SEQ ID NO: 3003 - protein, 5 aa, Chlamydia trachomatis
VGKNG

SEQ ID NO: 3004 - protein, 5 aa, Chlamydia trachomatis
GKNGS

SEQ ID NO: 3005 - protein, 5 aa, Chlamydia trachomatis
KNGSI

SEQ ID NO: 3006 - protein, 5 aa, Chlamydia trachomatis
NGSIT

SEQ ID NO: 3007 - protein, 5 aa, Chlamydia trachomatis
GSITV

SEQ ID NO: 3008 - protein, 5 aa, Chlamydia trachomatis
SITVE

SEQ ID NO: 3009 - protein, 5 aa, Chlamydia trachomatis
ITVEE

SEQ ID NO: 3010 - protein, 5 aa, Chlamydia trachomatis
TVEEA

SEQ ID NO: 3011 - protein, 5 aa, Chlamydia trachomatis
VEEAK

SEQ ID NO: 3012 - protein, 5 aa, Chlamydia trachomatis
EEAKG

SEQ ID NO: 3013 - protein, 5 aa, Chlamydia trachomatis
EAKGF

SEQ ID NO: 3014 - protein, 5 aa, Chlamydia trachomatis
AKGFE

SEQ ID NO: 3015 - protein, 5 aa, Chlamydia trachomatis
KGFET

SEQ ID NO: 3016 - protein, 5 aa, Chlamydia trachomatis
GFETV

SEQ ID NO: 3017 - protein, 5 aa, Chlamydia trachomatis
FETVL

SEQ ID NO: 3018 - protein, 5 aa, Chlamydia trachomatis
ETVLD

SEQ ID NO: 3019 - protein, 5 aa, Chlamydia trachomatis
TVLDV

SEQ ID NO: 3020 - protein, 5 aa, Chlamydia trachomatis
VLDVV

SEQ ID NO: 3021 - protein, 5 aa, Chlamydia trachomatis
LDVVE

SEQ ID NO: 3022 - protein, 5 aa, Chlamydia trachomatis
DVVEG

SEQ ID NO: 3023 - protein, 5 aa, Chlamydia trachomatis
VVEGM

SEQ ID NO: 3024 - protein, 5 aa, Chlamydia trachomatis
VEGMN

SEQ ID NO: 3025 - protein, 5 aa, Chlamydia trachomatis
EGMNF

SEQ ID NO: 3026 - protein, 5 aa, Chlamydia trachomatis
GMNFN

SEQ ID NO: 3027 - protein, 5 aa, Chlamydia trachomatis
MNFNR

SEQ ID NO: 3028 - protein, 5 aa, Chlamydia trachomatis
NFNRG

SEQ ID NO: 3029 - protein, 5 aa, Chlamydia trachomatis
FNRGY

SEQ ID NO: 3030 - protein, 5 aa, Chlamydia trachomatis
NRGYL

SEQ ID NO: 3031 - protein, 5 aa, Chlamydia trachomatis
RGYLS

SEQ ID NO: 3032 - protein, 5 aa, Chlamydia trachomatis
GYLSS

SEQ ID NO: 3033 - protein, 5 aa, Chlamydia trachomatis
YLSSY

SEQ ID NO: 3034 - protein, 5 aa, Chlamydia trachomatis
LSSYF

SEQ ID NO: 3035 - protein, 5 aa, Chlamydia trachomatis
SSYFA

SEQ ID NO: 3036 - protein, 5 aa, Chlamydia trachomatis
SYFAT

SEQ ID NO: 3037 - protein, 5 aa, Chlamydia trachomatis
YFATN

SEQ ID NO: 3038 - protein, 5 aa, Chlamydia trachomatis
FATNP

SEQ ID NO: 3039 - protein, 5 aa, Chlamydia trachomatis
ATNPE

SEQ ID NO: 3040 - protein, 5 aa, Chlamydia trachomatis
TNPET

SEQ ID NO: 3041 - protein, 5 aa, Chlamydia trachomatis
NPETQ

SEQ ID NO: 3042 - protein, 5 aa, Chlamydia trachomatis
PETQE

SEQ ID NO: 3043 - protein, 5 aa, Chlamydia trachomatis
ETQEC

SEQ ID NO: 3044 - protein, 5 aa, Chlamydia trachomatis
TQECV

SEQ ID NO: 3045 - protein, 5 aa, Chlamydia trachomatis
QECVL

SEQ ID NO: 3046 - protein, 5 aa, Chlamydia trachomatis
ECVLE

SEQ ID NO: 3047 - protein, 5 aa, Chlamydia trachomatis
CVLED

SEQ ID NO: 3048 - protein, 5 aa, Chlamydia trachomatis
VLEDA

SEQ ID NO: 3049 - protein, 5 aa, Chlamydia trachomatis
LEDAL

SEQ ID NO: 3050 - protein, 5 aa, Chlamydia trachomatis
EDALV

SEQ ID NO: 3051 - protein, 5 aa, Chlamydia trachomatis
DALVL

SEQ ID NO: 3052 - protein, 5 aa, Chlamydia trachomatis
ALVLI

SEQ ID NO: 3053 - protein, 5 aa, Chlamydia trachomatis
LVLIY

SEQ ID NO: 3054 - protein, 5 aa, Chlamydia trachomatis
VLIYD

SEQ ID NO: 3055 - protein, 5 aa, Chlamydia trachomatis
LIYDK

SEQ ID NO: 3056 - protein, 5 aa, Chlamydia trachomatis
IYDKK

SEQ ID NO: 3057 - protein, 5 aa, Chlamydia trachomatis
YDKKI

SEQ ID NO: 3058 - protein, 5 aa, Chlamydia trachomatis
DKKIS

SEQ ID NO: 3059 - protein, 5 aa, Chlamydia trachomatis
KKISG

SEQ ID NO: 3060 - protein, 5 aa, Chlamydia trachomatis
KISGI

SEQ ID NO: 3061 - protein, 5 aa, Chlamydia trachomatis
ISGIK

SEQ ID NO: 3062 - protein, 5 aa, Chlamydia trachomatis
SGIKD

SEQ ID NO: 3063 - protein, 5 aa, Chlamydia trachomatis
GIKDF

SEQ ID NO: 3064 - protein, 5 aa, Chlamydia trachomatis
IKDFL

SEQ ID NO: 3065 - protein, 5 aa, Chlamydia trachomatis
KDFLP

SEQ ID NO: 3066 - protein, 5 aa, Chlamydia trachomatis
DFLPV

SEQ ID NO: 3067 - protein, 5 aa, Chlamydia trachomatis
FLPVL

SEQ ID NO: 3068 - protein, 5 aa, Chlamydia trachomatis
LPVLQ

SEQ ID NO: 3069 - protein, 5 aa, Chlamydia trachomatis
PVLQQ

SEQ ID NO: 3070 - protein, 5 aa, Chlamydia trachomatis
VLQQV

SEQ ID NO: 3071 - protein, 5 aa, Chlamydia trachomatis
LQQVA

SEQ ID NO: 3072 - protein, 5 aa, Chlamydia trachomatis
QQVAE

SEQ ID NO: 3073 - protein, 5 aa, Chlamydia trachomatis
QVAES

SEQ ID NO: 3074 - protein, 5 aa, Chlamydia trachomatis
VAESG

SEQ ID NO: 3075 - protein, 5 aa, Chlamydia trachomatis
AESGR

SEQ ID NO: 3076 - protein, 5 aa, Chlamydia trachomatis
ESGRP

SEQ ID NO: 3077 - protein, 5 aa, Chlamydia trachomatis
SGRPL

SEQ ID NO: 3078 - protein, 5 aa, Chlamydia trachomatis
GRPLL

SEQ ID NO: 3079 - protein, 5 aa, Chlamydia trachomatis
RPLLI

SEQ ID NO: 3080 - protein, 5 aa, Chlamydia trachomatis
PLLII

SEQ ID NO: 3081 - protein, 5 aa, Chlamydia trachomatis
LLIIA

SEQ ID NO: 3082 - protein, 5 aa, Chlamydia trachomatis
LIIAE

SEQ ID NO: 3083 - protein, 5 aa, Chlamydia trachomatis
IIAED

SEQ ID NO: 3084 - protein, 5 aa, Chlamydia trachomatis
IAEDI

SEQ ID NO: 3085 - protein, 5 aa, Chlamydia trachomatis
AEDIE

SEQ ID NO: 3086 - protein, 5 aa, Chlamydia trachomatis
EDIEG

SEQ ID NO: 3087 - protein, 5 aa, Chlamydia trachomatis
DIEGE

SEQ ID NO: 3088 - protein, 5 aa, Chlamydia trachomatis
IEGEA

SEQ ID NO: 3089 - protein, 5 aa, Chlamydia trachomatis
EGEAL

SEQ ID NO: 3090 - protein, 5 aa, Chlamydia trachomatis
GEALA

SEQ ID NO: 3091 - protein, 5 aa, Chlamydia trachomatis
EALAT

SEQ ID NO: 3092 - protein, 5 aa, Chlamydia trachomatis
ALATL

SEQ ID NO: 3093 - protein, 5 aa, Chlamydia trachomatis
LATLV

SEQ ID NO: 3094 - protein, 5 aa, Chlamydia trachomatis
ATLVV

SEQ ID NO: 3095 - protein, 5 aa, Chlamydia trachomatis
TLVVN

SEQ ID NO: 3096 - protein, 5 aa, Chlamydia trachomatis
LVVNR

SEQ ID NO: 3097 - protein, 5 aa, Chlamydia trachomatis
VVNRI

SEQ ID NO: 3098 - protein, 5 aa, Chlamydia trachomatis
VNRIR

SEQ ID NO: 3099 - protein, 5 aa, Chlamydia trachomatis
NRIRG

SEQ ID NO: 3100 - protein, 5 aa, Chlamydia trachomatis
RIRGG

SEQ ID NO: 3101 - protein, 5 aa, Chlamydia trachomatis
IRGGF

SEQ ID NO: 3102 - protein, 5 aa, Chlamydia trachomatis
RGGFR

SEQ ID NO: 3103 - protein, 5 aa, Chlamydia trachomatis
GGFRV

SEQ ID NO: 3104 - protein, 5 aa, Chlamydia trachomatis
GFRVC

SEQ ID NO: 3105 - protein, 5 aa, Chlamydia trachomatis
FRVCA

SEQ ID NO: 3106 - protein, 5 aa, Chlamydia trachomatis
RVCAV

SEQ ID NO: 3107 - protein, 5 aa, Chlamydia trachomatis
VCAVK

SEQ ID NO: 3108 - protein, 5 aa, Chlamydia trachomatis
CAVKA

SEQ ID NO: 3109 - protein, 5 aa, Chlamydia trachomatis
AVKAP

SEQ ID NO: 3110 - protein, 5 aa, Chlamydia trachomatis
VKAPG

SEQ ID NO: 3111 - protein, 5 aa, Chlamydia trachomatis
KAPGF

SEQ ID NO: 3112 - protein, 5 aa, Chlamydia trachomatis
APGFG

SEQ ID NO: 3113 - protein, 5 aa, Chlamydia trachomatis
PGFGD

SEQ ID NO: 3114 - protein, 5 aa, Chlamydia trachomatis
GFGDR

SEQ ID NO: 3115 - protein, 5 aa, Chlamydia trachomatis
FGDRR

SEQ ID NO: 3116 - protein, 5 aa, Chlamydia trachomatis
GDRRK

SEQ ID NO: 3117 - protein, 5 aa, Chlamydia trachomatis
DRRKA

SEQ ID NO: 3118 - protein, 5 aa, Chlamydia trachomatis
RRKAM

SEQ ID NO: 3119 - protein, 5 aa, Chlamydia trachomatis
RKAML

SEQ ID NO: 3120 - protein, 5 aa, Chlamydia trachomatis
KAMLE

SEQ ID NO: 3121 - protein, 5 aa, Chlamydia trachomatis
AMLED

SEQ ID NO: 3122 - protein, 5 aa, Chlamydia trachomatis
MLEDI

SEQ ID NO: 3123 - protein, 5 aa, Chlamydia trachomatis
LEDIA

SEQ ID NO: 3124 - protein, 5 aa, Chlamydia trachomatis
EDIAI

SEQ ID NO: 3125 - protein, 5 aa, Chlamydia trachomatis
DIAIL

SEQ ID NO: 3126 - protein, 5 aa, Chlamydia trachomatis
IAILT

SEQ ID NO: 3127 - protein, 5 aa, Chlamydia trachomatis
AILTG

SEQ ID NO: 3128 - protein, 5 aa, Chlamydia trachomatis
ILTGG

SEQ ID NO: 3129 - protein, 5 aa, Chlamydia trachomatis
LTGGQ

SEQ ID NO: 3130 - protein, 5 aa, Chlamydia trachomatis
TGGQL

SEQ ID NO: 3131 - protein, 5 aa, Chlamydia trachomatis
GGQLI

SEQ ID NO: 3132 - protein, 5 aa, Chlamydia trachomatis
GQLIS

SEQ ID NO: 3133 - protein, 5 aa, Chlamydia trachomatis
QLISE

SEQ ID NO: 3134 - protein, 5 aa, Chlamydia trachomatis
LISEE

SEQ ID NO: 3135 - protein, 5 aa, Chlamydia trachomatis
ISEEL

SEQ ID NO: 3136 - protein, 5 aa, Chlamydia trachomatis
SEELG

SEQ ID NO: 3137 - protein, 5 aa, Chlamydia trachomatis
EELGM

SEQ ID NO: 3138 - protein, 5 aa, Chlamydia trachomatis
ELGMK

SEQ ID NO: 3139 - protein, 5 aa, Chlamydia trachomatis
LGMKL

SEQ ID NO: 3140 - protein, 5 aa, Chlamydia trachomatis
GMKLE

SEQ ID NO: 3141 - protein, 5 aa, Chlamydia trachomatis
MKLEN

SEQ ID NO: 3142 - protein, 5 aa, Chlamydia trachomatis
KLENA

SEQ ID NO: 3143 - protein, 5 aa, Chlamydia trachomatis
LENAN

SEQ ID NO: 3144 - protein, 5 aa, Chlamydia trachomatis
ENANL

SEQ ID NO: 3145 - protein, 5 aa, Chlamydia trachomatis
NANLA

SEQ ID NO: 3146 - protein, 5 aa, Chlamydia trachomatis
ANLAM

SEQ ID NO: 3147 - protein, 5 aa, Chlamydia trachomatis
NLAML

SEQ ID NO: 3148 - protein, 5 aa, Chlamydia trachomatis
LAMLG

SEQ ID NO: 3149 - protein, 5 aa, Chlamydia trachomatis
AMLGK

SEQ ID NO: 3150 - protein, 5 aa, Chlamydia trachomatis
MLGKA

SEQ ID NO: 3151 - protein, 5 aa, Chlamydia trachomatis
LGKAK

SEQ ID NO: 3152 - protein, 5 aa, Chlamydia trachomatis
GKAKK

SEQ ID NO: 3153 - protein, 5 aa, Chlamydia trachomatis
KAKKV

SEQ ID NO: 3154 - protein, 5 aa, Chlamydia trachomatis
AKKVI

SEQ ID NO: 3155 - protein, 5 aa, Chlamydia trachomatis
KKVIV

SEQ ID NO: 3156 - protein, 5 aa, Chlamydia trachomatis
KVIVS

SEQ ID NO: 3157 - protein, 5 aa, Chlamydia trachomatis
VIVSK

SEQ ID NO: 3158 - protein, 5 aa, Chlamydia trachomatis
IVSKE

SEQ ID NO: 3159 - protein, 5 aa, Chlamydia trachomatis
VSKED

SEQ ID NO: 3160 - protein, 5 aa, Chlamydia trachomatis
SKEDT

SEQ ID NO: 3161 - protein, 5 aa, Chlamydia trachomatis
KEDTT

SEQ ID NO: 3162 - protein, 5 aa, Chlamydia trachomatis
EDTTI

SEQ ID NO: 3163 - protein, 5 aa, Chlamydia trachomatis
DTTIV

SEQ ID NO: 3164 - protein, 5 aa, Chlamydia trachomatis
TTIVE

SEQ ID NO: 3165 - protein, 5 aa, Chlamydia trachomatis
TIVEG

SEQ ID NO: 3166 - protein, 5 aa, Chlamydia trachomatis
IVEGM

SEQ ID NO: 3167 - protein, 5 aa, Chlamydia trachomatis
VEGMG

SEQ ID NO: 3168 - protein, 5 aa, Chlamydia trachomatis
EGMGE

SEQ ID NO: 3169 - protein, 5 aa, Chlamydia trachomatis
GMGEK

SEQ ID NO: 3170 - protein, 5 aa, Chlamydia trachomatis
MGEKE

SEQ ID NO: 3171 - protein, 5 aa, Chlamydia trachomatis
GEKEA

SEQ ID NO: 3172 - protein, 5 aa, Chlamydia trachomatis
EKEAL

SEQ ID NO: 3173 - protein, 5 aa, Chlamydia trachomatis
KEALE

SEQ ID NO: 3174 - protein, 5 aa, Chlamydia trachomatis
EALEA

SEQ ID NO: 3175 - protein, 5 aa, Chlamydia trachomatis
ALEAR

SEQ ID NO: 3176 - protein, 5 aa, Chlamydia trachomatis
LEARC

SEQ ID NO: 3177 - protein, 5 aa, Chlamydia trachomatis
EARCE

SEQ ID NO: 3178 - protein, 5 aa, Chlamydia trachomatis
ARCES

SEQ ID NO: 3179 - protein, 5 aa, Chlamydia trachomatis
RCESI

SEQ ID NO: 3180 - protein, 5 aa, Chlamydia trachomatis
CESIK

SEQ ID NO: 3181 - protein, 5 aa, Chlamydia trachomatis
ESIKK

SEQ ID NO: 3182 - protein, 5 aa, Chlamydia trachomatis
SIKKQ

SEQ ID NO: 3183 - protein, 5 aa, Chlamydia trachomatis
IKKQI

SEQ ID NO: 3184 - protein, 5 aa, Chlamydia trachomatis
KKQIE

SEQ ID NO: 3185 - protein, 5 aa, Chlamydia trachomatis
KQIED

SEQ ID NO: 3186 - protein, 5 aa, Chlamydia trachomatis
QIEDS

SEQ ID NO: 3187 - protein, 5 aa, Chlamydia trachomatis
IEDSS

SEQ ID NO: 3188 - protein, 5 aa, Chlamydia trachomatis
EDSSS

SEQ ID NO: 3189 - protein, 5 aa, Chlamydia trachomatis
DSSSD

SEQ ID NO: 3190 - protein, 5 aa, Chlamydia trachomatis
SSSDY

SEQ ID NO: 3191 - protein, 5 aa, Chlamydia trachomatis
SSDYD

SEQ ID NO: 3192 - protein, 5 aa, Chlamydia trachomatis
SDYDK

SEQ ID NO: 3193 - protein, 5 aa, Chlamydia trachomatis
DYDKE

SEQ ID NO: 3194 - protein, 5 aa, Chlamydia trachomatis
YDKEK

SEQ ID NO: 3195 - protein, 5 aa, Chlamydia trachomatis
DKEKL

SEQ ID NO: 3196 - protein, 5 aa, Chlamydia trachomatis
KEKLQ

SEQ ID NO: 3197 - protein, 5 aa, Chlamydia trachomatis
EKLQE

SEQ ID NO: 3198 - protein, 5 aa, Chlamydia trachomatis
KLQER

SEQ ID NO: 3199 - protein, 5 aa, Chlamydia trachomatis
LQERL

SEQ ID NO: 3200 - protein, 5 aa, Chlamydia trachomatis
QERLA

SEQ ID NO: 3201 - protein, 5 aa, Chlamydia trachomatis
ERLAK

SEQ ID NO: 3202 - protein, 5 aa, Chlamydia trachomatis
RLAKL

SEQ ID NO: 3203 - protein, 5 aa, Chlamydia trachomatis
LAKLS

SEQ ID NO: 3204 - protein, 5 aa, Chlamydia trachomatis
AKLSG

SEQ ID NO: 3205 - protein, 5 aa, Chlamydia trachomatis
KLSGG

SEQ ID NO: 3206 - protein, 5 aa, Chlamydia trachomatis
LSGGV

SEQ ID NO: 3207 - protein, 5 aa, Chlamydia trachomatis
SGGVA

SEQ ID NO: 3208 - protein, 5 aa, Chlamydia trachomatis
GGVAV

SEQ ID NO: 3209 - protein, 5 aa, Chlamydia trachomatis
GVAVI

SEQ ID NO: 3210 - protein, 5 aa, Chlamydia trachomatis
VAVIR

SEQ ID NO: 3211 - protein, 5 aa, Chlamydia trachomatis
AVIRV

SEQ ID NO: 3212 - protein, 5 aa, Chlamydia trachomatis
VIRVG

SEQ ID NO: 3213 - protein, 5 aa, Chlamydia trachomatis
IRVGA

SEQ ID NO: 3214 - protein, 5 aa, Chlamydia trachomatis
RVGAA

SEQ ID NO: 3215 - protein, 5 aa, Chlamydia trachomatis
VGAAT

SEQ ID NO: 3216 - protein, 5 aa, Chlamydia trachomatis
GAATE

SEQ ID NO: 3217 - protein, 5 aa, Chlamydia trachomatis
AATEI

SEQ ID NO: 3218 - protein, 5 aa, Chlamydia trachomatis
ATEIE

SEQ ID NO: 3219 - protein, 5 aa, Chlamydia trachomatis
TEIEM

SEQ ID NO: 3220 - protein, 5 aa, Chlamydia trachomatis
EIEMK

SEQ ID NO: 3221 - protein, 5 aa, Chlamydia trachomatis
IEMKE

SEQ ID NO: 3222 - protein, 5 aa, Chlamydia trachomatis
EMKEK

SEQ ID NO: 3223 - protein, 5 aa, Chlamydia trachomatis
MKEKK

SEQ ID NO: 3224 - protein, 5 aa, Chlamydia trachomatis
KEKKD

SEQ ID NO: 3225 - protein, 5 aa, Chlamydia trachomatis
EKKDR

SEQ ID NO: 3226 - protein, 5 aa, Chlamydia trachomatis
KKDRV

SEQ ID NO: 3227 - protein, 5 aa, Chlamydia trachomatis
KDRVD

SEQ ID NO: 3228 - protein, 5 aa, Chlamydia trachomatis
DRVDD

SEQ ID NO: 3229 - protein, 5 aa, Chlamydia trachomatis
RVDDA

SEQ ID NO: 3230 - protein, 5 aa, Chlamydia trachomatis
VDDAQ

SEQ ID NO: 3231 - protein, 5 aa, Chlamydia trachomatis
DDAQH

SEQ ID NO: 3232 - protein, 5 aa, Chlamydia trachomatis
DAQHA

SEQ ID NO: 3233 - protein, 5 aa, Chlamydia trachomatis
AQHAT

SEQ ID NO: 3234 - protein, 5 aa, Chlamydia trachomatis
QHATI

SEQ ID NO: 3235 - protein, 5 aa, Chlamydia trachomatis
HATIA

SEQ ID NO: 3236 - protein, 5 aa, Chlamydia trachomatis
ATIAA

SEQ ID NO: 3237 - protein, 5 aa, Chlamydia trachomatis
TIAAV

SEQ ID NO: 3238 - protein, 5 aa, Chlamydia trachomatis
IAAVE

SEQ ID NO: 3239 - protein, 5 aa, Chlamydia trachomatis
AAVEE

SEQ ID NO: 3240 - protein, 5 aa, Chlamydia trachomatis
AVEEG

SEQ ID NO: 3241 - protein, 5 aa, Chlamydia trachomatis
VEEGI

SEQ ID NO: 3242 - protein, 5 aa, Chlamydia trachomatis
EEGIL

SEQ ID NO: 3243 - protein, 5 aa, Chlamydia trachomatis
EGILP

SEQ ID NO: 3244 - protein, 5 aa, Chlamydia trachomatis
GILPG

SEQ ID NO: 3245 - protein, 5 aa, Chlamydia trachomatis
ILPGG

SEQ ID NO: 3246 - protein, 5 aa, Chlamydia trachomatis
LPGGG

SEQ ID NO: 3247 - protein, 5 aa, Chlamydia trachomatis
PGGGT

SEQ ID NO: 3248 - protein, 5 aa, Chlamydia trachomatis
GGGTA

SEQ ID NO: 3249 - protein, 5 aa, Chlamydia trachomatis
GGTAL

SEQ ID NO: 3250 - protein, 5 aa, Chlamydia trachomatis
GTALI

SEQ ID NO: 3251 - protein, 5 aa, Chlamydia trachomatis
TALIR

SEQ ID NO: 3252 - protein, 5 aa, Chlamydia trachomatis
ALIRC

SEQ ID NO: 3253 - protein, 5 aa, Chlamydia trachomatis
LIRCI

SEQ ID NO: 3254 - protein, 5 aa, Chlamydia trachomatis
IRCIP

SEQ ID NO: 3255 - protein, 5 aa, Chlamydia trachomatis
RCIPT

SEQ ID NO: 3256 - protein, 5 aa, Chlamydia trachomatis
CIPTL

SEQ ID NO: 3257 - protein, 5 aa, Chlamydia trachomatis
IPTLE

SEQ ID NO: 3258 - protein, 5 aa, Chlamydia trachomatis
PTLEA

SEQ ID NO: 3259 - protein, 5 aa, Chlamydia trachomatis
TLEAF

SEQ ID NO: 3260 - protein, 5 aa, Chlamydia trachomatis
LEAFL

SEQ ID NO: 3261 - protein, 5 aa, Chlamydia trachomatis
EAFLP

SEQ ID NO: 3262 - protein, 5 aa, Chlamydia trachomatis
AFLPM

SEQ ID NO: 3263 - protein, 5 aa, Chlamydia trachomatis
FLPML

SEQ ID NO: 3264 - protein, 5 aa, Chlamydia trachomatis
LPMLT

SEQ ID NO: 3265 - protein, 5 aa, Chlamydia trachomatis
PMLTN

SEQ ID NO: 3266 - protein, 5 aa, Chlamydia trachomatis
MLTNE

SEQ ID NO: 3267 - protein, 5 aa, Chlamydia trachomatis
LTNED

SEQ ID NO: 3268 - protein, 5 aa, Chlamydia trachomatis
TNEDE

SEQ ID NO: 3269 - protein, 5 aa, Chlamydia trachomatis
NEDEQ

SEQ ID NO: 3270 - protein, 5 aa, Chlamydia trachomatis
EDEQI

SEQ ID NO: 3271 - protein, 5 aa, Chlamydia trachomatis
DEQIG

SEQ ID NO: 3272 - protein, 5 aa, Chlamydia trachomatis
EQIGA

SEQ ID NO: 3273 - protein, 5 aa, Chlamydia trachomatis
QIGAR

SEQ ID NO: 3274 - protein, 5 aa, Chlamydia trachomatis
IGARI

SEQ ID NO: 3275 - protein, 5 aa, Chlamydia trachomatis
GARIV

SEQ ID NO: 3276 - protein, 5 aa, Chlamydia trachomatis
ARIVL

SEQ ID NO: 3277 - protein, 5 aa, Chlamydia trachomatis
RIVLK

SEQ ID NO: 3278 - protein, 5 aa, Chlamydia trachomatis
IVLKA

SEQ ID NO: 3279 - protein, 5 aa, Chlamydia trachomatis
VLKAL

SEQ ID NO: 3280 - protein, 5 aa, Chlamydia trachomatis
LKALS

SEQ ID NO: 3281 - protein, 5 aa, Chlamydia trachomatis
KALSA

SEQ ID NO: 3282 - protein, 5 aa, Chlamydia trachomatis
ALSAP

SEQ ID NO: 3283 - protein, 5 aa, Chlamydia trachomatis
LSAPL

SEQ ID NO: 3284 - protein, 5 aa, Chlamydia trachomatis
SAPLK

SEQ ID NO: 3285 - protein, 5 aa, Chlamydia trachomatis
APLKQ

SEQ ID NO: 3286 - protein, 5 aa, Chlamydia trachomatis
PLKQI

SEQ ID NO: 3287 - protein, 5 aa, Chlamydia trachomatis
LKQIA

SEQ ID NO: 3288 - protein, 5 aa, Chlamydia trachomatis
KQIAA

SEQ ID NO: 3289 - protein, 5 aa, Chlamydia trachomatis
QIAAN

SEQ ID NO: 3290 - protein, 5 aa, Chlamydia trachomatis
IAANA

SEQ ID NO: 3291 - protein, 5 aa, Chlamydia trachomatis
AANAG

SEQ ID NO: 3292 - protein, 5 aa, Chlamydia trachomatis
ANAGK

SEQ ID NO: 3293 - protein, 5 aa, Chlamydia trachomatis
NAGKE

SEQ ID NO: 3294 - protein, 5 aa, Chlamydia trachomatis
AGKEG

SEQ ID NO: 3295 - protein, 5 aa, Chlamydia trachomatis
GKEGA

SEQ ID NO: 3296 - protein, 5 aa, Chlamydia trachomatis
KEGAI

SEQ ID NO: 3297 - protein, 5 aa, Chlamydia trachomatis
EGAII

SEQ ID NO: 3298 - protein, 5 aa, Chlamydia trachomatis
GAIIF

SEQ ID NO: 3299 - protein, 5 aa, Chlamydia trachomatis
AIIFQ

SEQ ID NO: 3300 - protein, 5 aa, Chlamydia trachomatis
IIFQQ

SEQ ID NO: 3301 - protein, 5 aa, Chlamydia trachomatis
IFQQV

SEQ ID NO: 3302 - protein, 5 aa, Chlamydia trachomatis
FQQVM

SEQ ID NO: 3303 - protein, 5 aa, Chlamydia trachomatis
QQVMS

SEQ ID NO: 3304 - protein, 5 aa, Chlamydia trachomatis
QVMSR

SEQ ID NO: 3305 - protein, 5 aa, Chlamydia trachomatis
VMSRS

SEQ ID NO: 3306 - protein, 5 aa, Chlamydia trachomatis
MSRSA

SEQ ID NO: 3307 - protein, 5 aa, Chlamydia trachomatis
SRSAN

SEQ ID NO: 3308 - protein, 5 aa, Chlamydia trachomatis
RSANE

SEQ ID NO: 3309 - protein, 5 aa, Chlamydia trachomatis
SANEG

SEQ ID NO: 3310 - protein, 5 aa, Chlamydia trachomatis
ANEGY

SEQ ID NO: 3311 - protein, 5 aa, Chlamydia trachomatis
NEGYD

SEQ ID NO: 3312 - protein, 5 aa, Chlamydia trachomatis
EGYDA

SEQ ID NO: 3313 - protein, 5 aa, Chlamydia trachomatis
GYDAL

SEQ ID NO: 3314 - protein, 5 aa, Chlamydia trachomatis
YDALR

SEQ ID NO: 3315 - protein, 5 aa, Chlamydia trachomatis
DALRD

SEQ ID NO: 3316 - protein, 5 aa, Chlamydia trachomatis
ALRDA

SEQ ID NO: 3317 - protein, 5 aa, Chlamydia trachomatis
LRDAY

SEQ ID NO: 3318 - protein, 5 aa, Chlamydia trachomatis
RDAYT

SEQ ID NO: 3319 - protein, 5 aa, Chlamydia trachomatis
DAYTD

SEQ ID NO: 3320 - protein, 5 aa, Chlamydia trachomatis
AYTDM

SEQ ID NO: 3321 - protein, 5 aa, Chlamydia trachomatis
YTDML

SEQ ID NO: 3322 - protein, 5 aa, Chlamydia trachomatis
TDMLE

SEQ ID NO: 3323 - protein, 5 aa, Chlamydia trachomatis
DMLEA

SEQ ID NO: 3324 - protein, 5 aa, Chlamydia trachomatis
MLEAG

SEQ ID NO: 3325 - protein, 5 aa, Chlamydia trachomatis
LEAGI

SEQ ID NO: 3326 - protein, 5 aa, Chlamydia trachomatis
EAGIL

SEQ ID NO: 3327 - protein, 5 aa, Chlamydia trachomatis
AGILD

SEQ ID NO: 3328 - protein, 5 aa, Chlamydia trachomatis
GILDP

SEQ ID NO: 3329 - protein, 5 aa, Chlamydia trachomatis
ILDPA

SEQ ID NO: 3330 - protein, 5 aa, Chlamydia trachomatis
LDPAK

SEQ ID NO: 3331 - protein, 5 aa, Chlamydia trachomatis
DPAKV

SEQ ID NO: 3332 - protein, 5 aa, Chlamydia trachomatis
PAKVT

SEQ ID NO: 3333 - protein, 5 aa, Chlamydia trachomatis
AKVTR

SEQ ID NO: 3334 - protein, 5 aa, Chlamydia trachomatis
KVTRS

SEQ ID NO: 3335 - protein, 5 aa, Chlamydia trachomatis
VTRSA

SEQ ID NO: 3336 - protein, 5 aa, Chlamydia trachomatis
TRSAL

SEQ ID NO: 3337 - protein, 5 aa, Chlamydia trachomatis
RSALE

SEQ ID NO: 3338 - protein, 5 aa, Chlamydia trachomatis
SALES

SEQ ID NO: 3339 - protein, 5 aa, Chlamydia trachomatis
ALESA

SEQ ID NO: 3340 - protein, 5 aa, Chlamydia trachomatis
LESAA

SEQ ID NO: 3341 - protein, 5 aa, Chlamydia trachomatis
ESAAS

SEQ ID NO: 3342 - protein, 5 aa, Chlamydia trachomatis
SAASV

SEQ ID NO: 3343 - protein, 5 aa, Chlamydia trachomatis
AASVA

SEQ ID NO: 3344 - protein, 5 aa, Chlamydia trachomatis
ASVAG

SEQ ID NO: 3345 - protein, 5 aa, Chlamydia trachomatis
SVAGL

SEQ ID NO: 3346 - protein, 5 aa, Chlamydia trachomatis
VAGLL

SEQ ID NO: 3347 - protein, 5 aa, Chlamydia trachomatis
AGLLL

SEQ ID NO: 3348 - protein, 5 aa, Chlamydia trachomatis
GLLLT

SEQ ID NO: 3349 - protein, 5 aa, Chlamydia trachomatis
LLLTT

SEQ ID NO: 3350 - protein, 5 aa, Chlamydia trachomatis
LLTTE

SEQ ID NO: 3351 - protein, 5 aa, Chlamydia trachomatis
LTTEA

SEQ ID NO: 3352 - protein, 5 aa, Chlamydia trachomatis
TTEAL

SEQ ID NO: 3353 - protein, 5 aa, Chlamydia trachomatis
TEALI

SEQ ID NO: 3354 - protein, 5 aa, Chlamydia trachomatis
EALIA

SEQ ID NO: 3355 - protein, 5 aa, Chlamydia trachomatis
ALIAE

SEQ ID NO: 3356 - protein, 5 aa, Chlamydia trachomatis
LIAEI

SEQ ID NO: 3357 - protein, 5 aa, Chlamydia trachomatis
IAEIP

SEQ ID NO: 3358 - protein, 5 aa, Chlamydia trachomatis
AEIPE

SEQ ID NO: 3359 - protein, 5 aa, Chlamydia trachomatis
EIPEE

SEQ ID NO: 3360 - protein, 5 aa, Chlamydia trachomatis
IPEEK

SEQ ID NO: 3361 - protein, 5 aa, Chlamydia trachomatis
PEEKP

SEQ ID NO: 3362 - protein, 5 aa, Chlamydia trachomatis
EEKPA

SEQ ID NO: 3363 - protein, 5 aa, Chlamydia trachomatis
EKPAA

SEQ ID NO: 3364 - protein, 5 aa, Chlamydia trachomatis
KPAAA

SEQ ID NO: 3365 - protein, 5 aa, Chlamydia trachomatis
PAAAP

SEQ ID NO: 3366 - protein, 5 aa, Chlamydia trachomatis
AAAPA

SEQ ID NO: 3367 - protein, 5 aa, Chlamydia trachomatis
AAPAM

SEQ ID NO: 3368 - protein, 5 aa, Chlamydia trachomatis
APAMP

SEQ ID NO: 3369 - protein, 5 aa, Chlamydia trachomatis
PAMPG

SEQ ID NO: 3370 - protein, 5 aa, Chlamydia trachomatis
AMPGA

SEQ ID NO: 3371 - protein, 5 aa, Chlamydia trachomatis
MPGAG

SEQ ID NO: 3372 - protein, 5 aa, Chlamydia trachomatis
PGAGM

SEQ ID NO: 3373 - protein, 5 aa, Chlamydia trachomatis
GAGMD

SEQ ID NO: 3374 - protein, 5 aa, Chlamydia trachomatis
AGMDY

SEQ ID NO: 3375 - protein, 5 aa, Chlamydia trachomatis
MVSQT

SEQ ID NO: 3376 - protein, 5 aa, Chlamydia trachomatis
VSQTV

SEQ ID NO: 3377 - protein, 5 aa, Chlamydia trachomatis
SQTVS

SEQ ID NO: 3378 - protein, 5 aa, Chlamydia trachomatis
QTVSV

SEQ ID NO: 3379 - protein, 5 aa, Chlamydia trachomatis
TVSVA

SEQ ID NO: 3380 - protein, 5 aa, Chlamydia trachomatis
VSVAV

SEQ ID NO: 3381 - protein, 5 aa, Chlamydia trachomatis
SVAVT

SEQ ID NO: 3382 - protein, 5 aa, Chlamydia trachomatis
VAVTG

SEQ ID NO: 3383 - protein, 5 aa, Chlamydia trachomatis
AVTGG

SEQ ID NO: 3384 - protein, 5 aa, Chlamydia trachomatis
VTGGT

SEQ ID NO: 3385 - protein, 5 aa, Chlamydia trachomatis
TGGTG

SEQ ID NO: 3386 - protein, 5 aa, Chlamydia trachomatis
GGTGQ

SEQ ID NO: 3387 - protein, 5 aa, Chlamydia trachomatis
GTGQI

SEQ ID NO: 3388 - protein, 5 aa, Chlamydia trachomatis
TGQIA

SEQ ID NO: 3389 - protein, 5 aa, Chlamydia trachomatis
GQIAY

SEQ ID NO: 3390 - protein, 5 aa, Chlamydia trachomatis
QIAYS

SEQ ID NO: 3391 - protein, 5 aa, Chlamydia trachomatis
IAYSF

SEQ ID NO: 3392 - protein, 5 aa, Chlamydia trachomatis
AYSFL

SEQ ID NO: 3393 - protein, 5 aa, Chlamydia trachomatis
YSFLF

SEQ ID NO: 3394 - protein, 5 aa, Chlamydia trachomatis
SFLFS

SEQ ID NO: 3395 - protein, 5 aa, Chlamydia trachomatis
FLFSL

SEQ ID NO: 3396 - protein, 5 aa, Chlamydia trachomatis
LFSLA

SEQ ID NO: 3397 - protein, 5 aa, Chlamydia trachomatis
FSLAH

SEQ ID NO: 3398 - protein, 5 aa, Chlamydia trachomatis
SLAHG

SEQ ID NO: 3399 - protein, 5 aa, Chlamydia trachomatis
LAHGD

SEQ ID NO: 3400 - protein, 5 aa, Chlamydia trachomatis
AHGDV

SEQ ID NO: 3401 - protein, 5 aa, Chlamydia trachomatis
HGDVF

SEQ ID NO: 3402 - protein, 5 aa, Chlamydia trachomatis
GDVFG

SEQ ID NO: 3403 - protein, 5 aa, Chlamydia trachomatis
DVFGL

SEQ ID NO: 3404 - protein, 5 aa, Chlamydia trachomatis
VFGLD

SEQ ID NO: 3405 - protein, 5 aa, Chlamydia trachomatis
FGLDC

SEQ ID NO: 3406 - protein, 5 aa, Chlamydia trachomatis
GLDCG

SEQ ID NO: 3407 - protein, 5 aa, Chlamydia trachomatis
LDCGI

SEQ ID NO: 3408 - protein, 5 aa, Chlamydia trachomatis
DCGID

SEQ ID NO: 3409 - protein, 5 aa, Chlamydia trachomatis
CGIDL

SEQ ID NO: 3410 - protein, 5 aa, Chlamydia trachomatis
GIDLR

SEQ ID NO: 3411 - protein, 5 aa, Chlamydia trachomatis
IDLRI

SEQ ID NO: 3412 - protein, 5 aa, Chlamydia trachomatis
DLRIY

SEQ ID NO: 3413 - protein, 5 aa, Chlamydia trachomatis
LRIYD

SEQ ID NO: 3414 - protein, 5 aa, Chlamydia trachomatis
RIYDI

SEQ ID NO: 3415 - protein, 5 aa, Chlamydia trachomatis
IYDIP

SEQ ID NO: 3416 - protein, 5 aa, Chlamydia trachomatis
YDIPG

SEQ ID NO: 3417 - protein, 5 aa, Chlamydia trachomatis
DIPGT

SEQ ID NO: 3418 - protein, 5 aa, Chlamydia trachomatis
IPGTE

SEQ ID NO: 3419 - protein, 5 aa, Chlamydia trachomatis
PGTER

SEQ ID NO: 3420 - protein, 5 aa, Chlamydia trachomatis
GTERA

SEQ ID NO: 3421 - protein, 5 aa, Chlamydia trachomatis
TERAL

SEQ ID NO: 3422 - protein, 5 aa, Chlamydia trachomatis
ERALS

SEQ ID NO: 3423 - protein, 5 aa, Chlamydia trachomatis
RALSG

SEQ ID NO: 3424 - protein, 5 aa, Chlamydia trachomatis
ALSGV

SEQ ID NO: 3425 - protein, 5 aa, Chlamydia trachomatis
LSGVR

SEQ ID NO: 3426 - protein, 5 aa, Chlamydia trachomatis
SGVRM

SEQ ID NO: 3427 - protein, 5 aa, Chlamydia trachomatis
GVRME

SEQ ID NO: 3428 - protein, 5 aa, Chlamydia trachomatis
VRMEL

SEQ ID NO: 3429 - protein, 5 aa, Chlamydia trachomatis
RMELD

SEQ ID NO: 3430 - protein, 5 aa, Chlamydia trachomatis
MELDD

SEQ ID NO: 3431 - protein, 5 aa, Chlamydia trachomatis
ELDDG

SEQ ID NO: 3432 - protein, 5 aa, Chlamydia trachomatis
LDDGA

SEQ ID NO: 3433 - protein, 5 aa, Chlamydia trachomatis
DDGAF

SEQ ID NO: 3434 - protein, 5 aa, Chlamydia trachomatis
DGAFP

SEQ ID NO: 3435 - protein, 5 aa, Chlamydia trachomatis
GAFPL

SEQ ID NO: 3436 - protein, 5 aa, Chlamydia trachomatis
AFPLL

SEQ ID NO: 3437 - protein, 5 aa, Chlamydia trachomatis
FPLLQ

SEQ ID NO: 3438 - protein, 5 aa, Chlamydia trachomatis
PLLQR

SEQ ID NO: 3439 - protein, 5 aa, Chlamydia trachomatis
LLQRV

SEQ ID NO: 3440 - protein, 5 aa, Chlamydia trachomatis
LQRVQ

SEQ ID NO: 3441 - protein, 5 aa, Chlamydia trachomatis
QRVQV

SEQ ID NO: 3442 - protein, 5 aa, Chlamydia trachomatis
RVQVT

SEQ ID NO: 3443 - protein, 5 aa, Chlamydia trachomatis
VQVTT

SEQ ID NO: 3444 - protein, 5 aa, Chlamydia trachomatis
QVTTS

SEQ ID NO: 3445 - protein, 5 aa, Chlamydia trachomatis
VTTSL

SEQ ID NO: 3446 - protein, 5 aa, Chlamydia trachomatis
TTSLH

SEQ ID NO: 3447 - protein, 5 aa, Chlamydia trachomatis
TSLHD

SEQ ID NO: 3448 - protein, 5 aa, Chlamydia trachomatis
SLHDA

SEQ ID NO: 3449 - protein, 5 aa, Chlamydia trachomatis
LHDAF

SEQ ID NO: 3450 - protein, 5 aa, Chlamydia trachomatis
HDAFD

SEQ ID NO: 3451 - protein, 5 aa, Chlamydia trachomatis
DAFDG

SEQ ID NO: 3452 - protein, 5 aa, Chlamydia trachomatis
AFDGI

SEQ ID NO: 3453 - protein, 5 aa, Chlamydia trachomatis
FDGID

SEQ ID NO: 3454 - protein, 5 aa, Chlamydia trachomatis
DGIDA

SEQ ID NO: 3455 - protein, 5 aa, Chlamydia trachomatis
GIDAA

SEQ ID NO: 3456 - protein, 5 aa, Chlamydia trachomatis
IDAAF

SEQ ID NO: 3457 - protein, 5 aa, Chlamydia trachomatis
DAAFL

SEQ ID NO: 3458 - protein, 5 aa, Chlamydia trachomatis
AAFLI

SEQ ID NO: 3459 - protein, 5 aa, Chlamydia trachomatis
AFLIG

SEQ ID NO: 3460 - protein, 5 aa, Chlamydia trachomatis
FLIGS

SEQ ID NO: 3461 - protein, 5 aa, Chlamydia trachomatis
LIGSV

SEQ ID NO: 3462 - protein, 5 aa, Chlamydia trachomatis
IGSVP

SEQ ID NO: 3463 - protein, 5 aa, Chlamydia trachomatis
GSVPR

SEQ ID NO: 3464 - protein, 5 aa, Chlamydia trachomatis
SVPRG

SEQ ID NO: 3465 - protein, 5 aa, Chlamydia trachomatis
VPRGP

SEQ ID NO: 3466 - protein, 5 aa, Chlamydia trachomatis
PRGPG

SEQ ID NO: 3467 - protein, 5 aa, Chlamydia trachomatis
RGPGM

SEQ ID NO: 3468 - protein, 5 aa, Chlamydia trachomatis
GPGME

SEQ ID NO: 3469 - protein, 5 aa, Chlamydia trachomatis
PGMER

SEQ ID NO: 3470 - protein, 5 aa, Chlamydia trachomatis
GMERR

SEQ ID NO: 3471 - protein, 5 aa, Chlamydia trachomatis
MERRD

SEQ ID NO: 3472 - protein, 5 aa, Chlamydia trachomatis
ERRDL

SEQ ID NO: 3473 - protein, 5 aa, Chlamydia trachomatis
RRDLL

SEQ ID NO: 3474 - protein, 5 aa, Chlamydia trachomatis
RDLLK

SEQ ID NO: 3475 - protein, 5 aa, Chlamydia trachomatis
DLLKK

SEQ ID NO: 3476 - protein, 5 aa, Chlamydia trachomatis
LLKKN

SEQ ID NO: 3477 - protein, 5 aa, Chlamydia trachomatis
LKKNG

SEQ ID NO: 3478 - protein, 5 aa, Chlamydia trachomatis
KKNGE

SEQ ID NO: 3479 - protein, 5 aa, Chlamydia trachomatis
KNGEI

SEQ ID NO: 3480 - protein, 5 aa, Chlamydia trachomatis
NGEIF

SEQ ID NO: 3481 - protein, 5 aa, Chlamydia trachomatis
GEIFA

SEQ ID NO: 3482 - protein, 5 aa, Chlamydia trachomatis
EIFAT

SEQ ID NO: 3483 - protein, 5 aa, Chlamydia trachomatis
IFATQ

SEQ ID NO: 3484 - protein, 5 aa, Chlamydia trachomatis
FATQG

SEQ ID NO: 3485 - protein, 5 aa, Chlamydia trachomatis
ATQGK

SEQ ID NO: 3486 - protein, 5 aa, Chlamydia trachomatis
TQGKA

SEQ ID NO: 3487 - protein, 5 aa, Chlamydia trachomatis
QGKAL

SEQ ID NO: 3488 - protein, 5 aa, Chlamydia trachomatis
GKALN

SEQ ID NO: 3489 - protein, 5 aa, Chlamydia trachomatis
KALNT

SEQ ID NO: 3490 - protein, 5 aa, Chlamydia trachomatis
ALNTT

SEQ ID NO: 3491 - protein, 5 aa, Chlamydia trachomatis
LNTTA

SEQ ID NO: 3492 - protein, 5 aa, Chlamydia trachomatis
NTTAK

SEQ ID NO: 3493 - protein, 5 aa, Chlamydia trachomatis
TTAKR

SEQ ID NO: 3494 - protein, 5 aa, Chlamydia trachomatis
TAKRD

SEQ ID NO: 3495 - protein, 5 aa, Chlamydia trachomatis
AKRDA

SEQ ID NO: 3496 - protein, 5 aa, Chlamydia trachomatis
KRDAK

SEQ ID NO: 3497 - protein, 5 aa, Chlamydia trachomatis
RDAKI

SEQ ID NO: 3498 - protein, 5 aa, Chlamydia trachomatis
DAKIF

SEQ ID NO: 3499 - protein, 5 aa, Chlamydia trachomatis
AKIFV

SEQ ID NO: 3500 - protein, 5 aa, Chlamydia trachomatis
KIFVV

SEQ ID NO: 3501 - protein, 5 aa, Chlamydia trachomatis
IFVVG

SEQ ID NO: 3502 - protein, 5 aa, Chlamydia trachomatis
FVVGN

SEQ ID NO: 3503 - protein, 5 aa, Chlamydia trachomatis
VVGNP

SEQ ID NO: 3504 - protein, 5 aa, Chlamydia trachomatis
VGNPV

SEQ ID NO: 3505 - protein, 5 aa, Chlamydia trachomatis
GNPVN

SEQ ID NO: 3506 - protein, 5 aa, Chlamydia trachomatis
NPVNT

SEQ ID NO: 3507 - protein, 5 aa, Chlamydia trachomatis
PVNTN

SEQ ID NO: 3508 - protein, 5 aa, Chlamydia trachomatis
VNTNC

SEQ ID NO: 3509 - protein, 5 aa, Chlamydia trachomatis
NTNCW

SEQ ID NO: 3510 - protein, 5 aa, Chlamydia trachomatis
TNCWI

SEQ ID NO: 3511 - protein, 5 aa, Chlamydia trachomatis
NCWIA

SEQ ID NO: 3512 - protein, 5 aa, Chlamydia trachomatis
CWIAM

SEQ ID NO: 3513 - protein, 5 aa, Chlamydia trachomatis
WIAMN

SEQ ID NO: 3514 - protein, 5 aa, Chlamydia trachomatis
IAMNH

SEQ ID NO: 3515 - protein, 5 aa, Chlamydia trachomatis
AMNHA

SEQ ID NO: 3516 - protein, 5 aa, Chlamydia trachomatis
MNHAP

SEQ ID NO: 3517 - protein, 5 aa, Chlamydia trachomatis
NHAPR

SEQ ID NO: 3518 - protein, 5 aa, Chlamydia trachomatis
HAPRL

SEQ ID NO: 3519 - protein, 5 aa, Chlamydia trachomatis
APRLL

SEQ ID NO: 3520 - protein, 5 aa, Chlamydia trachomatis
PRLLR

SEQ ID NO: 3521 - protein, 5 aa, Chlamydia trachomatis
RLLRK

SEQ ID NO: 3522 - protein, 5 aa, Chlamydia trachomatis
LLRKN

SEQ ID NO: 3523 - protein, 5 aa, Chlamydia trachomatis
LRKNF

SEQ ID NO: 3524 - protein, 5 aa, Chlamydia trachomatis
RKNFH

SEQ ID NO: 3525 - protein, 5 aa, Chlamydia trachomatis
KNFHA

SEQ ID NO: 3526 - protein, 5 aa, Chlamydia trachomatis
NFHAM

SEQ ID NO: 3527 - protein, 5 aa, Chlamydia trachomatis
FHAML

SEQ ID NO: 3528 - protein, 5 aa, Chlamydia trachomatis
HAMLR

SEQ ID NO: 3529 - protein, 5 aa, Chlamydia trachomatis
AMLRL

SEQ ID NO: 3530 - protein, 5 aa, Chlamydia trachomatis
MLRLD

SEQ ID NO: 3531 - protein, 5 aa, Chlamydia trachomatis
LRLDQ

SEQ ID NO: 3532 - protein, 5 aa, Chlamydia trachomatis
RLDQN

SEQ ID NO: 3533 - protein, 5 aa, Chlamydia trachomatis
LDQNR

SEQ ID NO: 3534 - protein, 5 aa, Chlamydia trachomatis
DQNRM

SEQ ID NO: 3535 - protein, 5 aa, Chlamydia trachomatis
QNRMH

SEQ ID NO: 3536 - protein, 5 aa, Chlamydia trachomatis
NRMHS

SEQ ID NO: 3537 - protein, 5 aa, Chlamydia trachomatis
RMHSM

SEQ ID NO: 3538 - protein, 5 aa, Chlamydia trachomatis
MHSML

SEQ ID NO: 3539 - protein, 5 aa, Chlamydia trachomatis
HSMLS

SEQ ID NO: 3540 - protein, 5 aa, Chlamydia trachomatis
SMLSH

SEQ ID NO: 3541 - protein, 5 aa, Chlamydia trachomatis
MLSHR

SEQ ID NO: 3542 - protein, 5 aa, Chlamydia trachomatis
LSHRA

SEQ ID NO: 3543 - protein, 5 aa, Chlamydia trachomatis
SHRAE

SEQ ID NO: 3544 - protein, 5 aa, Chlamydia trachomatis
HRAEV

SEQ ID NO: 3545 - protein, 5 aa, Chlamydia trachomatis
RAEVP

SEQ ID NO: 3546 - protein, 5 aa, Chlamydia trachomatis
AEVPL

SEQ ID NO: 3547 - protein, 5 aa, Chlamydia trachomatis
EVPLS

SEQ ID NO: 3548 - protein, 5 aa, Chlamydia trachomatis
VPLSA

SEQ ID NO: 3549 - protein, 5 aa, Chlamydia trachomatis
PLSAV

SEQ ID NO: 3550 - protein, 5 aa, Chlamydia trachomatis
LSAVS

SEQ ID NO: 3551 - protein, 5 aa, Chlamydia trachomatis
SAVSQ

SEQ ID NO: 3552 - protein, 5 aa, Chlamydia trachomatis
AVSQV

SEQ ID NO: 3553 - protein, 5 aa, Chlamydia trachomatis
VSQVV

SEQ ID NO: 3554 - protein, 5 aa, Chlamydia trachomatis
SQVVV

SEQ ID NO: 3555 - protein, 5 aa, Chlamydia trachomatis
QVVVW

SEQ ID NO: 3556 - protein, 5 aa, Chlamydia trachomatis
VVVWG

SEQ ID NO: 3557 - protein, 5 aa, Chlamydia trachomatis
VVWGN

SEQ ID NO: 3558 - protein, 5 aa, Chlamydia trachomatis
VWGNH

SEQ ID NO: 3559 - protein, 5 aa, Chlamydia trachomatis
WGNHS

SEQ ID NO: 3560 - protein, 5 aa, Chlamydia trachomatis
GNHSA

SEQ ID NO: 3561 - protein, 5 aa, Chlamydia trachomatis
NHSAK

SEQ ID NO: 3562 - protein, 5 aa, Chlamydia trachomatis
HSAKQ

SEQ ID NO: 3563 - protein, 5 aa, Chlamydia trachomatis
SAKQV

SEQ ID NO: 3564 - protein, 5 aa, Chlamydia trachomatis
AKQVP

SEQ ID NO: 3565 - protein, 5 aa, Chlamydia trachomatis
KQVPD

SEQ ID NO: 3566 - protein, 5 aa, Chlamydia trachomatis
QVPDF

SEQ ID NO: 3567 - protein, 5 aa, Chlamydia trachomatis
VPDFT

SEQ ID NO: 3568 - protein, 5 aa, Chlamydia trachomatis
PDFTQ

SEQ ID NO: 3569 - protein, 5 aa, Chlamydia trachomatis
DFTQA

SEQ ID NO: 3570 - protein, 5 aa, Chlamydia trachomatis
FTQAL

SEQ ID NO: 3571 - protein, 5 aa, Chlamydia trachomatis
TQALI

SEQ ID NO: 3572 - protein, 5 aa, Chlamydia trachomatis
QALIN

SEQ ID NO: 3573 - protein, 5 aa, Chlamydia trachomatis
ALIND

SEQ ID NO: 3574 - protein, 5 aa, Chlamydia trachomatis
LINDR

SEQ ID NO: 3575 - protein, 5 aa, Chlamydia trachomatis
INDRP

SEQ ID NO: 3576 - protein, 5 aa, Chlamydia trachomatis
NDRPI

SEQ ID NO: 3577 - protein, 5 aa, Chlamydia trachomatis
DRPIA

SEQ ID NO: 3578 - protein, 5 aa, Chlamydia trachomatis
RPIAE

SEQ ID NO: 3579 - protein, 5 aa, Chlamydia trachomatis
PIAET

SEQ ID NO: 3580 - protein, 5 aa, Chlamydia trachomatis
IAETI

SEQ ID NO: 3581 - protein, 5 aa, Chlamydia trachomatis
AETIA

SEQ ID NO: 3582 - protein, 5 aa, Chlamydia trachomatis
ETIAD

SEQ ID NO: 3583 - protein, 5 aa, Chlamydia trachomatis
TIADR

SEQ ID NO: 3584 - protein, 5 aa, Chlamydia trachomatis
IADRD

SEQ ID NO: 3585 - protein, 5 aa, Chlamydia trachomatis
ADRDW

SEQ ID NO: 3586 - protein, 5 aa, Chlamydia trachomatis
DRDWL

SEQ ID NO: 3587 - protein, 5 aa, Chlamydia trachomatis
RDWLE

SEQ ID NO: 3588 - protein, 5 aa, Chlamydia trachomatis
DWLEN

SEQ ID NO: 3589 - protein, 5 aa, Chlamydia trachomatis
WLENI

SEQ ID NO: 3590 - protein, 5 aa, Chlamydia trachomatis
LENIM

SEQ ID NO: 3591 - protein, 5 aa, Chlamydia trachomatis
ENIMV

SEQ ID NO: 3592 - protein, 5 aa, Chlamydia trachomatis
NIMVP

SEQ ID NO: 3593 - protein, 5 aa, Chlamydia trachomatis
IMVPS

SEQ ID NO: 3594 - protein, 5 aa, Chlamydia trachomatis
MVPSV

SEQ ID NO: 3595 - protein, 5 aa, Chlamydia trachomatis
VPSVQ

SEQ ID NO: 3596 - protein, 5 aa, Chlamydia trachomatis
PSVQS

SEQ ID NO: 3597 - protein, 5 aa, Chlamydia trachomatis
SVQSR

SEQ ID NO: 3598 - protein, 5 aa, Chlamydia trachomatis
VQSRG

SEQ ID NO: 3599 - protein, 5 aa, Chlamydia trachomatis
QSRGS

SEQ ID NO: 3600 - protein, 5 aa, Chlamydia trachomatis
SRGSA

SEQ ID NO: 3601 - protein, 5 aa, Chlamydia trachomatis
RGSAV

SEQ ID NO: 3602 - protein, 5 aa, Chlamydia trachomatis
GSAVI

SEQ ID NO: 3603 - protein, 5 aa, Chlamydia trachomatis
SAVIE

SEQ ID NO: 3604 - protein, 5 aa, Chlamydia trachomatis
AVIEA

SEQ ID NO: 3605 - protein, 5 aa, Chlamydia trachomatis
VIEAR

SEQ ID NO: 3606 - protein, 5 aa, Chlamydia trachomatis
IEARG

SEQ ID NO: 3607 - protein, 5 aa, Chlamydia trachomatis
EARGK

SEQ ID NO: 3608 - protein, 5 aa, Chlamydia trachomatis
ARGKS

SEQ ID NO: 3609 - protein, 5 aa, Chlamydia trachomatis
RGKSS

SEQ ID NO: 3610 - protein, 5 aa, Chlamydia trachomatis
GKSSA

SEQ ID NO: 3611 - protein, 5 aa, Chlamydia trachomatis
KSSAA

SEQ ID NO: 3612 - protein, 5 aa, Chlamydia trachomatis
SSAAS

SEQ ID NO: 3613 - protein, 5 aa, Chlamydia trachomatis
SAASA

SEQ ID NO: 3614 - protein, 5 aa, Chlamydia trachomatis
AASAA

SEQ ID NO: 3615 - protein, 5 aa, Chlamydia trachomatis
ASAAR

SEQ ID NO: 3616 - protein, 5 aa, Chlamydia trachomatis
SAARA

SEQ ID NO: 3617 - protein, 5 aa, Chlamydia trachomatis
AARAL

SEQ ID NO: 3618 - protein, 5 aa, Chlamydia trachomatis
ARALA

SEQ ID NO: 3619 - protein, 5 aa, Chlamydia trachomatis
RALAE

SEQ ID NO: 3620 - protein, 5 aa, Chlamydia trachomatis
ALAEA

SEQ ID NO: 3621 - protein, 5 aa, Chlamydia trachomatis
LAEAA

SEQ ID NO: 3622 - protein, 5 aa, Chlamydia trachomatis
AEAAR

SEQ ID NO: 3623 - protein, 5 aa, Chlamydia trachomatis
EAARS

SEQ ID NO: 3624 - protein, 5 aa, Chlamydia trachomatis
AARSI

SEQ ID NO: 3625 - protein, 5 aa, Chlamydia trachomatis
ARSIY

SEQ ID NO: 3626 - protein, 5 aa, Chlamydia trachomatis
RSIYQ

SEQ ID NO: 3627 - protein, 5 aa, Chlamydia trachomatis
SIYQP

SEQ ID NO: 3628 - protein, 5 aa, Chlamydia trachomatis
IYQPK

SEQ ID NO: 3629 - protein, 5 aa, Chlamydia trachomatis
YQPKE

SEQ ID NO: 3630 - protein, 5 aa, Chlamydia trachomatis
QPKEG

SEQ ID NO: 3631 - protein, 5 aa, Chlamydia trachomatis
PKEGE

SEQ ID NO: 3632 - protein, 5 aa, Chlamydia trachomatis
KEGEW

SEQ ID NO: 3633 - protein, 5 aa, Chlamydia trachomatis
EGEWF

SEQ ID NO: 3634 - protein, 5 aa, Chlamydia trachomatis
GEWFS

SEQ ID NO: 3635 - protein, 5 aa, Chlamydia trachomatis
EWFSS

SEQ ID NO: 3636 - protein, 5 aa, Chlamydia trachomatis
WFSSG

SEQ ID NO: 3637 - protein, 5 aa, Chlamydia trachomatis
FSSGV

SEQ ID NO: 3638 - protein, 5 aa, Chlamydia trachomatis
SSGVC

SEQ ID NO: 3639 - protein, 5 aa, Chlamydia trachomatis
SGVCS

SEQ ID NO: 3640 - protein, 5 aa, Chlamydia trachomatis
GVCSD

SEQ ID NO: 3641 - protein, 5 aa, Chlamydia trachomatis
VCSDH

SEQ ID NO: 3642 - protein, 5 aa, Chlamydia trachomatis
CSDHN

SEQ ID NO: 3643 - protein, 5 aa, Chlamydia trachomatis
SDHNP

SEQ ID NO: 3644 - protein, 5 aa, Chlamydia trachomatis
DHNPY

SEQ ID NO: 3645 - protein, 5 aa, Chlamydia trachomatis
HNPYG

SEQ ID NO: 3646 - protein, 5 aa, Chlamydia trachomatis
NPYGL

SEQ ID NO: 3647 - protein, 5 aa, Chlamydia trachomatis
PYGLP

SEQ ID NO: 3648 - protein, 5 aa, Chlamydia trachomatis
YGLPE

SEQ ID NO: 3649 - protein, 5 aa, Chlamydia trachomatis
GLPED

SEQ ID NO: 3650 - protein, 5 aa, Chlamydia trachomatis
LPEDL

SEQ ID NO: 3651 - protein, 5 aa, Chlamydia trachomatis
PEDLI

SEQ ID NO: 3652 - protein, 5 aa, Chlamydia trachomatis
EDLIF

SEQ ID NO: 3653 - protein, 5 aa, Chlamydia trachomatis
DLIFG

SEQ ID NO: 3654 - protein, 5 aa, Chlamydia trachomatis
LIFGF

SEQ ID NO: 3655 - protein, 5 aa, Chlamydia trachomatis
IFGFP

SEQ ID NO: 3656 - protein, 5 aa, Chlamydia trachomatis
FGFPC

SEQ ID NO: 3657 - protein, 5 aa, Chlamydia trachomatis
GFPCR

SEQ ID NO: 3658 - protein, 5 aa, Chlamydia trachomatis
FPCRM

SEQ ID NO: 3659 - protein, 5 aa, Chlamydia trachomatis
PCRML

SEQ ID NO: 3660 - protein, 5 aa, Chlamydia trachomatis
CRMLA

SEQ ID NO: 3661 - protein, 5 aa, Chlamydia trachomatis
RMLAT

SEQ ID NO: 3662 - protein, 5 aa, Chlamydia trachomatis
MLATG

SEQ ID NO: 3663 - protein, 5 aa, Chlamydia trachomatis
LATGE

SEQ ID NO: 3664 - protein, 5 aa, Chlamydia trachomatis
ATGEY

SEQ ID NO: 3665 - protein, 5 aa, Chlamydia trachomatis
TGEYE

SEQ ID NO: 3666 - protein, 5 aa, Chlamydia trachomatis
GEYEV

SEQ ID NO: 3667 - protein, 5 aa, Chlamydia trachomatis
EYEVI

SEQ ID NO: 3668 - protein, 5 aa, Chlamydia trachomatis
YEVIP

SEQ ID NO: 3669 - protein, 5 aa, Chlamydia trachomatis
EVIPR

SEQ ID NO: 3670 - protein, 5 aa, Chlamydia trachomatis
VIPRL

SEQ ID NO: 3671 - protein, 5 aa, Chlamydia trachomatis
IPRLP

SEQ ID NO: 3672 - protein, 5 aa, Chlamydia trachomatis
PRLPW

SEQ ID NO: 3673 - protein, 5 aa, Chlamydia trachomatis
RLPWD

SEQ ID NO: 3674 - protein, 5 aa, Chlamydia trachomatis
LPWDA

SEQ ID NO: 3675 - protein, 5 aa, Chlamydia trachomatis
PWDAF

SEQ ID NO: 3676 - protein, 5 aa, Chlamydia trachomatis
WDAFI

SEQ ID NO: 3677 - protein, 5 aa, Chlamydia trachomatis
DAFIR

SEQ ID NO: 3678 - protein, 5 aa, Chlamydia trachomatis
AFIRG

SEQ ID NO: 3679 - protein, 5 aa, Chlamydia trachomatis
FIRGK

SEQ ID NO: 3680 - protein, 5 aa, Chlamydia trachomatis
IRGKM

SEQ ID NO: 3681 - protein, 5 aa, Chlamydia trachomatis
RGKMQ

SEQ ID NO: 3682 - protein, 5 aa, Chlamydia trachomatis
GKMQI

SEQ ID NO: 3683 - protein, 5 aa, Chlamydia trachomatis
KMQIS

SEQ ID NO: 3684 - protein, 5 aa, Chlamydia trachomatis
MQISL

SEQ ID NO: 3685 - protein, 5 aa, Chlamydia trachomatis
QISLD

SEQ ID NO: 3686 - protein, 5 aa, Chlamydia trachomatis
ISLDE

SEQ ID NO: 3687 - protein, 5 aa, Chlamydia trachomatis
SLDEI

SEQ ID NO: 3688 - protein, 5 aa, Chlamydia trachomatis
LDEIL

SEQ ID NO: 3689 - protein, 5 aa, Chlamydia trachomatis
DEILQ

SEQ ID NO: 3690 - protein, 5 aa, Chlamydia trachomatis
EILQE

SEQ ID NO: 3691 - protein, 5 aa, Chlamydia trachomatis
ILQEK

SEQ ID NO: 3692 - protein, 5 aa, Chlamydia trachomatis
LQEKA

SEQ ID NO: 3693 - protein, 5 aa, Chlamydia trachomatis
QEKAS

SEQ ID NO: 3694 - protein, 5 aa, Chlamydia trachomatis
EKASV

SEQ ID NO: 3695 - protein, 5 aa, Chlamydia trachomatis
KASVS

SEQ ID NO: 3696 - protein, 5 aa, Chlamydia trachomatis
ASVSL

SEQ ID NO: 3697 - protein, 5 aa, Chlamydia trachomatis
MVSQT

SEQ ID NO: 3698 - protein, 5 aa, Chlamydia trachomatis
VSQTV

SEQ ID NO: 3699 - protein, 5 aa, Chlamydia trachomatis
SQTVS

SEQ ID NO: 3700 - protein, 5 aa, Chlamydia trachomatis
QTVSV

SEQ ID NO: 3701 - protein, 5 aa, Chlamydia trachomatis
TVSVA

SEQ ID NO: 3702 - protein, 5 aa, Chlamydia trachomatis
VSVAV

SEQ ID NO: 3703 - protein, 5 aa, Chlamydia trachomatis
SVAVT

SEQ ID NO: 3704 - protein, 5 aa, Chlamydia trachomatis
VAVTG

SEQ ID NO: 3705 - protein, 5 aa, Chlamydia trachomatis
AVTGG

SEQ ID NO: 3706 - protein, 5 aa, Chlamydia trachomatis
VTGGT

SEQ ID NO: 3707 - protein, 5 aa, Chlamydia trachomatis
TGGTG

SEQ ID NO: 3708 - protein, 5 aa, Chlamydia trachomatis
GGTGQ

SEQ ID NO: 3709 - protein, 5 aa, Chlamydia trachomatis
GTGQI

SEQ ID NO: 3710 - protein, 5 aa, Chlamydia trachomatis
TGQIA

SEQ ID NO: 3711 - protein, 5 aa, Chlamydia trachomatis
GQIAY

SEQ ID NO: 3712 - protein, 5 aa, Chlamydia trachomatis
QIAYS

SEQ ID NO: 3713 - protein, 5 aa, Chlamydia trachomatis
IAYSF

SEQ ID NO: 3714 - protein, 5 aa, Chlamydia trachomatis
AYSFL

SEQ ID NO: 3715 - protein, 5 aa, Chlamydia trachomatis
YSFLF

SEQ ID NO: 3716 - protein, 5 aa, Chlamydia trachomatis
SFLFS

SEQ ID NO: 3717 - protein, 5 aa, Chlamydia trachomatis
FLFSL

SEQ ID NO: 3718 - protein, 5 aa, Chlamydia trachomatis
LFSLA

SEQ ID NO: 3719 - protein, 5 aa, Chlamydia trachomatis
FSLAH

SEQ ID NO: 3720 - protein, 5 aa, Chlamydia trachomatis
SLAHG

SEQ ID NO: 3721 - protein, 5 aa, Chlamydia trachomatis
LAHGD

SEQ ID NO: 3722 - protein, 5 aa, Chlamydia trachomatis
AHGDV

SEQ ID NO: 3723 - protein, 5 aa, Chlamydia trachomatis
HGDVF

SEQ ID NO: 3724 - protein, 5 aa, Chlamydia trachomatis
GDVFG

SEQ ID NO: 3725 - protein, 5 aa, Chlamydia trachomatis
DVFGL

SEQ ID NO: 3726 - protein, 5 aa, Chlamydia trachomatis
VFGLD

SEQ ID NO: 3727 - protein, 5 aa, Chlamydia trachomatis
FGLDC

SEQ ID NO: 3728 - protein, 5 aa, Chlamydia trachomatis
GLDCG

SEQ ID NO: 3729 - protein, 5 aa, Chlamydia trachomatis
LDCGI

SEQ ID NO: 3730 - protein, 5 aa, Chlamydia trachomatis
DCGID

SEQ ID NO: 3731 - protein, 5 aa, Chlamydia trachomatis
CGIDL

SEQ ID NO: 3732 - protein, 5 aa, Chlamydia trachomatis
GIDLR

SEQ ID NO: 3733 - protein, 5 aa, Chlamydia trachomatis
IDLRI

SEQ ID NO: 3734 - protein, 5 aa, Chlamydia trachomatis
DLRIY

SEQ ID NO: 3735 - protein, 5 aa, Chlamydia trachomatis
LRIYD

SEQ ID NO: 3736 - protein, 5 aa, Chlamydia trachomatis
RIYDI

SEQ ID NO: 3737 - protein, 5 aa, Chlamydia trachomatis
IYDIP

SEQ ID NO: 3738 - protein, 5 aa, Chlamydia trachomatis
YDIPG

SEQ ID NO: 3739 - protein, 5 aa, Chlamydia trachomatis
DIPGT

SEQ ID NO: 3740 - protein, 5 aa, Chlamydia trachomatis
IPGTE

SEQ ID NO: 3741 - protein, 5 aa, Chlamydia trachomatis
PGTER

SEQ ID NO: 3742 - protein, 5 aa, Chlamydia trachomatis
GTERA

SEQ ID NO: 3743 - protein, 5 aa, Chlamydia trachomatis
TERAL

SEQ ID NO: 3744 - protein, 5 aa, Chlamydia trachomatis
ERALS

SEQ ID NO: 3745 - protein, 5 aa, Chlamydia trachomatis
RALSG

SEQ ID NO: 3746 - protein, 5 aa, Chlamydia trachomatis
ALSGV

SEQ ID NO: 3747 - protein, 5 aa, Chlamydia trachomatis
LSGVR

SEQ ID NO: 3748 - protein, 5 aa, Chlamydia trachomatis
SGVRM

SEQ ID NO: 3749 - protein, 5 aa, Chlamydia trachomatis
GVRME

SEQ ID NO: 3750 - protein, 5 aa, Chlamydia trachomatis
VRMEL

SEQ ID NO: 3751 - protein, 5 aa, Chlamydia trachomatis
RMELD

SEQ ID NO: 3752 - protein, 5 aa, Chlamydia trachomatis
MELDD

SEQ ID NO: 3753 - protein, 5 aa, Chlamydia trachomatis
ELDDG

SEQ ID NO: 3754 - protein, 5 aa, Chlamydia trachomatis
LDDGA

SEQ ID NO: 3755 - protein, 5 aa, Chlamydia trachomatis
DDGAF

SEQ ID NO: 3756 - protein, 5 aa, Chlamydia trachomatis
DGAFP

SEQ ID NO: 3757 - protein, 5 aa, Chlamydia trachomatis
GAFPL

SEQ ID NO: 3758 - protein, 5 aa, Chlamydia trachomatis
AFPLL

SEQ ID NO: 3759 - protein, 5 aa, Chlamydia trachomatis
FPLLQ

SEQ ID NO: 3760 - protein, 5 aa, Chlamydia trachomatis
PLLQR

SEQ ID NO: 3761 - protein, 5 aa, Chlamydia trachomatis
LLQRV

SEQ ID NO: 3762 - protein, 5 aa, Chlamydia trachomatis
LQRVQ

SEQ ID NO: 3763 - protein, 5 aa, Chlamydia trachomatis
QRVQV

SEQ ID NO: 3764 - protein, 5 aa, Chlamydia trachomatis
RVQVT

SEQ ID NO: 3765 - protein, 5 aa, Chlamydia trachomatis
VQVTT

SEQ ID NO: 3766 - protein, 5 aa, Chlamydia trachomatis
QVTTS

SEQ ID NO: 3767 - protein, 5 aa, Chlamydia trachomatis
VTTSL

SEQ ID NO: 3768 - protein, 5 aa, Chlamydia trachomatis
TTSLH

SEQ ID NO: 3769 - protein, 5 aa, Chlamydia trachomatis
TSLHD

SEQ ID NO: 3770 - protein, 5 aa, Chlamydia trachomatis
SLHDA

SEQ ID NO: 3771 - protein, 5 aa, Chlamydia trachomatis
LHDAF

SEQ ID NO: 3772 - protein, 5 aa, Chlamydia trachomatis
HDAFD

SEQ ID NO: 3773 - protein, 5 aa, Chlamydia trachomatis
DAFDG

SEQ ID NO: 3774 - protein, 5 aa, Chlamydia trachomatis
AFDGI

SEQ ID NO: 3775 - protein, 5 aa, Chlamydia trachomatis
FDGID

SEQ ID NO: 3776 - protein, 5 aa, Chlamydia trachomatis
DGIDA

SEQ ID NO: 3777 - protein, 5 aa, Chlamydia trachomatis
GIDAA

SEQ ID NO: 3778 - protein, 5 aa, Chlamydia trachomatis
IDAAF

SEQ ID NO: 3779 - protein, 5 aa, Chlamydia trachomatis
DAAFL

SEQ ID NO: 3780 - protein, 5 aa, Chlamydia trachomatis
AAFLI

SEQ ID NO: 3781 - protein, 5 aa, Chlamydia trachomatis
AFLIG

SEQ ID NO: 3782 - protein, 5 aa, Chlamydia trachomatis
FLIGS

SEQ ID NO: 3783 - protein, 5 aa, Chlamydia trachomatis
LIGSV

SEQ ID NO: 3784 - protein, 5 aa, Chlamydia trachomatis
IGSVP

SEQ ID NO: 3785 - protein, 5 aa, Chlamydia trachomatis
GSVPR

SEQ ID NO: 3786 - protein, 5 aa, Chlamydia trachomatis
SVPRG

SEQ ID NO: 3787 - protein, 5 aa, Chlamydia trachomatis
VPRGP

SEQ ID NO: 3788 - protein, 5 aa, Chlamydia trachomatis
PRGPG

SEQ ID NO: 3789 - protein, 5 aa, Chlamydia trachomatis
RGPGM

SEQ ID NO: 3790 - protein, 5 aa, Chlamydia trachomatis
GPGME

SEQ ID NO: 3791 - protein, 5 aa, Chlamydia trachomatis
PGMER

SEQ ID NO: 3792 - protein, 5 aa, Chlamydia trachomatis
GMERR

SEQ ID NO: 3793 - protein, 5 aa, Chlamydia trachomatis
MERRD

SEQ ID NO: 3794 - protein, 5 aa, Chlamydia trachomatis
ERRDL

SEQ ID NO: 3795 - protein, 5 aa, Chlamydia trachomatis
RRDLL

SEQ ID NO: 3796 - protein, 5 aa, Chlamydia trachomatis
RDLLK

SEQ ID NO: 3797 - protein, 5 aa, Chlamydia trachomatis
DLLKK

SEQ ID NO: 3798 - protein, 5 aa, Chlamydia trachomatis
LLKKN

SEQ ID NO: 3799 - protein, 5 aa, Chlamydia trachomatis
LKKNG

SEQ ID NO: 3800 - protein, 5 aa, Chlamydia trachomatis
KKNGE

SEQ ID NO: 3801 - protein, 5 aa, Chlamydia trachomatis
KNGEI

SEQ ID NO: 3802 - protein, 5 aa, Chlamydia trachomatis
NGEIF

SEQ ID NO: 3803 - protein, 5 aa, Chlamydia trachomatis
GEIFA

SEQ ID NO: 3804 - protein, 5 aa, Chlamydia trachomatis
EIFAT

SEQ ID NO: 3805 - protein, 5 aa, Chlamydia trachomatis
IFATQ

SEQ ID NO: 3806 - protein, 5 aa, Chlamydia trachomatis
FATQG

SEQ ID NO: 3807 - protein, 5 aa, Chlamydia trachomatis
ATQGK

SEQ ID NO: 3808 - protein, 5 aa, Chlamydia trachomatis
TQGKA

SEQ ID NO: 3809 - protein, 5 aa, Chlamydia trachomatis
QGKAL

SEQ ID NO: 3810 - protein, 5 aa, Chlamydia trachomatis
GKALN

SEQ ID NO: 3811 - protein, 5 aa, Chlamydia trachomatis
KALNT

SEQ ID NO: 3812 - protein, 5 aa, Chlamydia trachomatis
ALNTT

SEQ ID NO: 3813 - protein, 5 aa, Chlamydia trachomatis
LNTTA

SEQ ID NO: 3814 - protein, 5 aa, Chlamydia trachomatis
NTTAK

SEQ ID NO: 3815 - protein, 5 aa, Chlamydia trachomatis
TTAKR

SEQ ID NO: 3816 - protein, 5 aa, Chlamydia trachomatis
TAKRD

SEQ ID NO: 3817 - protein, 5 aa, Chlamydia trachomatis
AKRDA

SEQ ID NO: 3818 - protein, 5 aa, Chlamydia trachomatis
KRDAK

SEQ ID NO: 3819 - protein, 5 aa, Chlamydia trachomatis
RDAKI

SEQ ID NO: 3820 - protein, 5 aa, Chlamydia trachomatis
DAKIF

SEQ ID NO: 3821 - protein, 5 aa, Chlamydia trachomatis
AKIFV

SEQ ID NO: 3822 - protein, 5 aa, Chlamydia trachomatis
KIFVV

SEQ ID NO: 3823 - protein, 5 aa, Chlamydia trachomatis
IFVVG

SEQ ID NO: 3824 - protein, 5 aa, Chlamydia trachomatis
FVVGN

SEQ ID NO: 3825 - protein, 5 aa, Chlamydia trachomatis
VVGNP

SEQ ID NO: 3826 - protein, 5 aa, Chlamydia trachomatis
VGNPV

SEQ ID NO: 3827 - protein, 5 aa, Chlamydia trachomatis
GNPVN

SEQ ID NO: 3828 - protein, 5 aa, Chlamydia trachomatis
NPVNT

SEQ ID NO: 3829 - protein, 5 aa, Chlamydia trachomatis
PVNTN

SEQ ID NO: 3830 - protein, 5 aa, Chlamydia trachomatis
VNTNC

SEQ ID NO: 3831 - protein, 5 aa, Chlamydia trachomatis
NTNCW

SEQ ID NO: 3832 - protein, 5 aa, Chlamydia trachomatis
TNCWI

SEQ ID NO: 3833 - protein, 5 aa, Chlamydia trachomatis
NCWIA

SEQ ID NO: 3834 - protein, 5 aa, Chlamydia trachomatis
CWIAM

SEQ ID NO: 3835 - protein, 5 aa, Chlamydia trachomatis
WIAMN

SEQ ID NO: 3836 - protein, 5 aa, Chlamydia trachomatis
IAMNH

SEQ ID NO: 3837 - protein, 5 aa, Chlamydia trachomatis
AMNHA

SEQ ID NO: 3838 - protein, 5 aa, Chlamydia trachomatis
MNHAP

SEQ ID NO: 3839 - protein, 5 aa, Chlamydia trachomatis
NHAPR

SEQ ID NO: 3840 - protein, 5 aa, Chlamydia trachomatis
HAPRL

SEQ ID NO: 3841 - protein, 5 aa, Chlamydia trachomatis
APRLL

SEQ ID NO: 3842 - protein, 5 aa, Chlamydia trachomatis
PRLLR

SEQ ID NO: 3843 - protein, 5 aa, Chlamydia trachomatis
RLLRK

SEQ ID NO: 3844 - protein, 5 aa, Chlamydia trachomatis
LLRKN

SEQ ID NO: 3845 - protein, 5 aa, Chlamydia trachomatis
LRKNF

SEQ ID NO: 3846 - protein, 5 aa, Chlamydia trachomatis
RKNFH

SEQ ID NO: 3847 - protein, 5 aa, Chlamydia trachomatis
KNFHA

SEQ ID NO: 3848 - protein, 5 aa, Chlamydia trachomatis
NFHAM

SEQ ID NO: 3849 - protein, 5 aa, Chlamydia trachomatis
FHAML

SEQ ID NO: 3850 - protein, 5 aa, Chlamydia trachomatis
HAMLR

SEQ ID NO: 3851 - protein, 5 aa, Chlamydia trachomatis
AMLRL

SEQ ID NO: 3852 - protein, 5 aa, Chlamydia trachomatis
MLRLD

SEQ ID NO: 3853 - protein, 5 aa, Chlamydia trachomatis
LRLDQ

SEQ ID NO: 3854 - protein, 5 aa, Chlamydia trachomatis
RLDQN

SEQ ID NO: 3855 - protein, 5 aa, Chlamydia trachomatis
LDQNR

SEQ ID NO: 3856 - protein, 5 aa, Chlamydia trachomatis
DQNRM

SEQ ID NO: 3857 - protein, 5 aa, Chlamydia trachomatis
QNRMH

SEQ ID NO: 3858 - protein, 5 aa, Chlamydia trachomatis
NRMHS

SEQ ID NO: 3859 - protein, 5 aa, Chlamydia trachomatis
RMHSM

SEQ ID NO: 3860 - protein, 5 aa, Chlamydia trachomatis
MHSML

SEQ ID NO: 3861 - protein, 5 aa, Chlamydia trachomatis
HSMLS

SEQ ID NO: 3862 - protein, 5 aa, Chlamydia trachomatis
SMLSH

SEQ ID NO: 3863 - protein, 5 aa, Chlamydia trachomatis
MLSHR

SEQ ID NO: 3864 - protein, 5 aa, Chlamydia trachomatis
LSHRA

SEQ ID NO: 3865 - protein, 5 aa, Chlamydia trachomatis
SHRAE

SEQ ID NO: 3866 - protein, 5 aa, Chlamydia trachomatis
HRAEV

SEQ ID NO: 3867 - protein, 5 aa, Chlamydia trachomatis
RAEVP

SEQ ID NO: 3868 - protein, 5 aa, Chlamydia trachomatis
AEVPL

SEQ ID NO: 3869 - protein, 5 aa, Chlamydia trachomatis
EVPLS

SEQ ID NO: 3870 - protein, 5 aa, Chlamydia trachomatis
VPLSA

SEQ ID NO: 3871 - protein, 5 aa, Chlamydia trachomatis
PLSAV

SEQ ID NO: 3872 - protein, 5 aa, Chlamydia trachomatis
LSAVS

SEQ ID NO: 3873 - protein, 5 aa, Chlamydia trachomatis
SAVSQ

SEQ ID NO: 3874 - protein, 5 aa, Chlamydia trachomatis
AVSQV

SEQ ID NO: 3875 - protein, 5 aa, Chlamydia trachomatis
VSQVV

SEQ ID NO: 3876 - protein, 5 aa, Chlamydia trachomatis
SQVVV

SEQ ID NO: 3877 - protein, 5 aa, Chlamydia trachomatis
QVVVW

SEQ ID NO: 3878 - protein, 5 aa, Chlamydia trachomatis
VVVWG

SEQ ID NO: 3879 - protein, 5 aa, Chlamydia trachomatis
VVWGN

SEQ ID NO: 3880 - protein, 5 aa, Chlamydia trachomatis
VWGNH

SEQ ID NO: 3881 - protein, 5 aa, Chlamydia trachomatis
WGNHS

SEQ ID NO: 3882 - protein, 5 aa, Chlamydia trachomatis
GNHSA

SEQ ID NO: 3883 - protein, 5 aa, Chlamydia trachomatis
NHSAK

SEQ ID NO: 3884 - protein, 5 aa, Chlamydia trachomatis
HSAKQ

SEQ ID NO: 3885 - protein, 5 aa, Chlamydia trachomatis
SAKQV

SEQ ID NO: 3886 - protein, 5 aa, Chlamydia trachomatis
AKQVP

SEQ ID NO: 3887 - protein, 5 aa, Chlamydia trachomatis
KQVPD

SEQ ID NO: 3888 - protein, 5 aa, Chlamydia trachomatis
QVPDF

SEQ ID NO: 3889 - protein, 5 aa, Chlamydia trachomatis
VPDFT

SEQ ID NO: 3890 - protein, 5 aa, Chlamydia trachomatis
PDFTQ

SEQ ID NO: 3891 - protein, 5 aa, Chlamydia trachomatis
DFTQA

SEQ ID NO: 3892 - protein, 5 aa, Chlamydia trachomatis
FTQAL

SEQ ID NO: 3893 - protein, 5 aa, Chlamydia trachomatis
TQALI

SEQ ID NO: 3894 - protein, 5 aa, Chlamydia trachomatis
QALIN

SEQ ID NO: 3895 - protein, 5 aa, Chlamydia trachomatis
ALIND

SEQ ID NO: 3896 - protein, 5 aa, Chlamydia trachomatis
LINDR

SEQ ID NO: 3897 - protein, 5 aa, Chlamydia trachomatis
INDRP

SEQ ID NO: 3898 - protein, 5 aa, Chlamydia trachomatis
NDRPI

SEQ ID NO: 3899 - protein, 5 aa, Chlamydia trachomatis
DRPIA

SEQ ID NO: 3900 - protein, 5 aa, Chlamydia trachomatis
RPIAE

SEQ ID NO: 3901 - protein, 5 aa, Chlamydia trachomatis
PIAET

SEQ ID NO: 3902 - protein, 5 aa, Chlamydia trachomatis
IAETI

SEQ ID NO: 3903 - protein, 5 aa, Chlamydia trachomatis
AETIA

SEQ ID NO: 3904 - protein, 5 aa, Chlamydia trachomatis
ETIAD

SEQ ID NO: 3905 - protein, 5 aa, Chlamydia trachomatis
TIADR

SEQ ID NO: 3906 - protein, 5 aa, Chlamydia trachomatis
IADRD

SEQ ID NO: 3907 - protein, 5 aa, Chlamydia trachomatis
ADRDW

SEQ ID NO: 3908 - protein, 5 aa, Chlamydia trachomatis
DRDWL

SEQ ID NO: 3909 - protein, 5 aa, Chlamydia trachomatis
RDWLE

SEQ ID NO: 3910 - protein, 5 aa, Chlamydia trachomatis
DWLEN

SEQ ID NO: 3911 - protein, 5 aa, Chlamydia trachomatis
WLENI

SEQ ID NO: 3912 - protein, 5 aa, Chlamydia trachomatis
LENIM

SEQ ID NO: 3913 - protein, 5 aa, Chlamydia trachomatis
ENIMV

SEQ ID NO: 3914 - protein, 5 aa, Chlamydia trachomatis
NIMVP

SEQ ID NO: 3915 - protein, 5 aa, Chlamydia trachomatis
IMVPS

SEQ ID NO: 3916 - protein, 5 aa, Chlamydia trachomatis
MVPSV

SEQ ID NO: 3917 - protein, 5 aa, Chlamydia trachomatis
VPSVQ

SEQ ID NO: 3918 - protein, 5 aa, Chlamydia trachomatis
PSVQS

SEQ ID NO: 3919 - protein, 5 aa, Chlamydia trachomatis
SVQSR

SEQ ID NO: 3920 - protein, 5 aa, Chlamydia trachomatis
VQSRG

SEQ ID NO: 3921 - protein, 5 aa, Chlamydia trachomatis
QSRGS

SEQ ID NO: 3922 - protein, 5 aa, Chlamydia trachomatis
SRGSA

SEQ ID NO: 3923 - protein, 5 aa, Chlamydia trachomatis
RGSAV

SEQ ID NO: 3924 - protein, 5 aa, Chlamydia trachomatis
GSAVI

SEQ ID NO: 3925 - protein, 5 aa, Chlamydia trachomatis
SAVIE

SEQ ID NO: 3926 - protein, 5 aa, Chlamydia trachomatis
AVIEA

SEQ ID NO: 3927 - protein, 5 aa, Chlamydia trachomatis
VIEAR

SEQ ID NO: 3928 - protein, 5 aa, Chlamydia trachomatis
IEARG

SEQ ID NO: 3929 - protein, 5 aa, Chlamydia trachomatis
EARGK

SEQ ID NO: 3930 - protein, 5 aa, Chlamydia trachomatis
ARGKS

SEQ ID NO: 3931 - protein, 5 aa, Chlamydia trachomatis
RGKSS

SEQ ID NO: 3932 - protein, 5 aa, Chlamydia trachomatis
GKSSA

SEQ ID NO: 3933 - protein, 5 aa, Chlamydia trachomatis
KSSAA

SEQ ID NO: 3934 - protein, 5 aa, Chlamydia trachomatis
SSAAS

SEQ ID NO: 3935 - protein, 5 aa, Chlamydia trachomatis
SAASA

SEQ ID NO: 3936 - protein, 5 aa, Chlamydia trachomatis
AASAA

SEQ ID NO: 3937 - protein, 5 aa, Chlamydia trachomatis
ASAAR

SEQ ID NO: 3938 - protein, 5 aa, Chlamydia trachomatis
SAARA

SEQ ID NO: 3939 - protein, 5 aa, Chlamydia trachomatis
AARAL

SEQ ID NO: 3940 - protein, 5 aa, Chlamydia trachomatis
ARALA

SEQ ID NO: 3941 - protein, 5 aa, Chlamydia trachomatis
RALAE

SEQ ID NO: 3942 - protein, 5 aa, Chlamydia trachomatis
ALAEA

SEQ ID NO: 3943 - protein, 5 aa, Chlamydia trachomatis
LAEAA

SEQ ID NO: 3944 - protein, 5 aa, Chlamydia trachomatis
AEAAR

SEQ ID NO: 3945 - protein, 5 aa, Chlamydia trachomatis
EAARS

SEQ ID NO: 3946 - protein, 5 aa, Chlamydia trachomatis
AARSI

SEQ ID NO: 3947 - protein, 5 aa, Chlamydia trachomatis
ARSIY

SEQ ID NO: 3948 - protein, 5 aa, Chlamydia trachomatis
RSIYQ

SEQ ID NO: 3949 - protein, 5 aa, Chlamydia trachomatis
SIYQP

SEQ ID NO: 3950 - protein, 5 aa, Chlamydia trachomatis
IYQPK

SEQ ID NO: 3951 - protein, 5 aa, Chlamydia trachomatis
YQPKE

SEQ ID NO: 3952 - protein, 5 aa, Chlamydia trachomatis
QPKEG

SEQ ID NO: 3953 - protein, 5 aa, Chlamydia trachomatis
PKEGE

SEQ ID NO: 3954 - protein, 5 aa, Chlamydia trachomatis
KEGEW

SEQ ID NO: 3955 - protein, 5 aa, Chlamydia trachomatis
EGEWF

SEQ ID NO: 3956 - protein, 5 aa, Chlamydia trachomatis
GEWFS

SEQ ID NO: 3957 - protein, 5 aa, Chlamydia trachomatis
EWFSS

SEQ ID NO: 3958 - protein, 5 aa, Chlamydia trachomatis
WFSSG

SEQ ID NO: 3959 - protein, 5 aa, Chlamydia trachomatis
FSSGV

SEQ ID NO: 3960 - protein, 5 aa, Chlamydia trachomatis
SSGVC

SEQ ID NO: 3961 - protein, 5 aa, Chlamydia trachomatis
SGVCS

SEQ ID NO: 3962 - protein, 5 aa, Chlamydia trachomatis
GVCSD

SEQ ID NO: 3963 - protein, 5 aa, Chlamydia trachomatis
VCSDH

SEQ ID NO: 3964 - protein, 5 aa, Chlamydia trachomatis
CSDHN

SEQ ID NO: 3965 - protein, 5 aa, Chlamydia trachomatis
SDHNP

SEQ ID NO: 3966 - protein, 5 aa, Chlamydia trachomatis
DHNPY

SEQ ID NO: 3967 - protein, 5 aa, Chlamydia trachomatis
HNPYG

SEQ ID NO: 3968 - protein, 5 aa, Chlamydia trachomatis
NPYGL

SEQ ID NO: 3969 - protein, 5 aa, Chlamydia trachomatis
PYGLP

SEQ ID NO: 3970 - protein, 5 aa, Chlamydia trachomatis
YGLPE

SEQ ID NO: 3971 - protein, 5 aa, Chlamydia trachomatis
GLPED

SEQ ID NO: 3972 - protein, 5 aa, Chlamydia trachomatis
LPEDL

SEQ ID NO: 3973 - protein, 5 aa, Chlamydia trachomatis
PEDLI

SEQ ID NO: 3974 - protein, 5 aa, Chlamydia trachomatis
EDLIF

SEQ ID NO: 3975 - protein, 5 aa, Chlamydia trachomatis
DLIFG

SEQ ID NO: 3976 - protein, 5 aa, Chlamydia trachomatis
LIFGF

SEQ ID NO: 3977 - protein, 5 aa, Chlamydia trachomatis
IFGFP

SEQ ID NO: 3978 - protein, 5 aa, Chlamydia trachomatis
FGFPC

SEQ ID NO: 3979 - protein, 5 aa, Chlamydia trachomatis
GFPCR

SEQ ID NO: 3980 - protein, 5 aa, Chlamydia trachomatis
FPCRM

SEQ ID NO: 3981 - protein, 5 aa, Chlamydia trachomatis
PCRML

SEQ ID NO: 3982 - protein, 5 aa, Chlamydia trachomatis
CRMLA

SEQ ID NO: 3983 - protein, 5 aa, Chlamydia trachomatis
RMLAT

SEQ ID NO: 3984 - protein, 5 aa, Chlamydia trachomatis
MLATG

SEQ ID NO: 3985 - protein, 5 aa, Chlamydia trachomatis
LATGE

SEQ ID NO: 3986 - protein, 5 aa, Chlamydia trachomatis
ATGEY

SEQ ID NO: 3987 - protein, 5 aa, Chlamydia trachomatis
TGEYE

SEQ ID NO: 3988 - protein, 5 aa, Chlamydia trachomatis
GEYEV

SEQ ID NO: 3989 - protein, 5 aa, Chlamydia trachomatis
EYEVI

SEQ ID NO: 3990 - protein, 5 aa, Chlamydia trachomatis
YEVIP

SEQ ID NO: 3991 - protein, 5 aa, Chlamydia trachomatis
EVIPR

SEQ ID NO: 3992 - protein, 5 aa, Chlamydia trachomatis
VIPRL

SEQ ID NO: 3993 - protein, 5 aa, Chlamydia trachomatis
IPRLP

SEQ ID NO: 3994 - protein, 5 aa, Chlamydia trachomatis
PRLPW

SEQ ID NO: 3995 - protein, 5 aa, Chlamydia trachomatis
RLPWD

SEQ ID NO: 3996 - protein, 5 aa, Chlamydia trachomatis
LPWDA

SEQ ID NO: 3997 - protein, 5 aa, Chlamydia trachomatis
PWDAF

SEQ ID NO: 3998 - protein, 5 aa, Chlamydia trachomatis
WDAFI

SEQ ID NO: 3999 - protein, 5 aa, Chlamydia trachomatis
DAFIR

SEQ ID NO: 4000 - protein, 5 aa, Chlamydia trachomatis
AFIRG

SEQ ID NO: 4001 - protein, 5 aa, Chlamydia trachomatis
FIRGK

SEQ ID NO: 4002 - protein, 5 aa, Chlamydia trachomatis
IRGKM

SEQ ID NO: 4003 - protein, 5 aa, Chlamydia trachomatis
RGKMQ

SEQ ID NO: 4004 - protein, 5 aa, Chlamydia trachomatis
GKMQI

SEQ ID NO: 4005 - protein, 5 aa, Chlamydia trachomatis
KMQIS

SEQ ID NO: 4006 - protein, 5 aa, Chlamydia trachomatis
MQISL

SEQ ID NO: 4007 - protein, 5 aa, Chlamydia trachomatis
QISLD

SEQ ID NO: 4008 - protein, 5 aa, Chlamydia trachomatis
ISLDE

SEQ ID NO: 4009 - protein, 5 aa, Chlamydia trachomatis
SLDEI

SEQ ID NO: 4010 - protein, 5 aa, Chlamydia trachomatis
LDEIL

SEQ ID NO: 4011 - protein, 5 aa, Chlamydia trachomatis
DEILQ

SEQ ID NO: 4012 - protein, 5 aa, Chlamydia trachomatis
EILQE

SEQ ID NO: 4013 - protein, 5 aa, Chlamydia trachomatis
ILQEK

SEQ ID NO: 4014 - protein, 5 aa, Chlamydia trachomatis
LQEKA

SEQ ID NO: 4015 - protein, 5 aa, Chlamydia trachomatis
QEKAS

SEQ ID NO: 4016 - protein, 5 aa, Chlamydia trachomatis
EKASV

SEQ ID NO: 4017 - protein, 5 aa, Chlamydia trachomatis
KASVS

SEQ ID NO: 4018 - protein, 5 aa, Chlamydia trachomatis
ASVSL

SEQ ID NO: 4019 - protein, 5 aa, Chlamydia trachomatis
MGFWR

SEQ ID NO: 4020 - protein, 5 aa, Chlamydia trachomatis
GFWRT

SEQ ID NO: 4021 - protein, 5 aa, Chlamydia trachomatis
FWRTS

SEQ ID NO: 4022 - protein, 5 aa, Chlamydia trachomatis
WRTSI

SEQ ID NO: 4023 - protein, 5 aa, Chlamydia trachomatis
RTSIM

SEQ ID NO: 4024 - protein, 5 aa, Chlamydia trachomatis
TSIMK

SEQ ID NO: 4025 - protein, 5 aa, Chlamydia trachomatis
SIMKM

SEQ ID NO: 4026 - protein, 5 aa, Chlamydia trachomatis
IMKMN

SEQ ID NO: 4027 - protein, 5 aa, Chlamydia trachomatis
MKMNR

SEQ ID NO: 4028 - protein, 5 aa, Chlamydia trachomatis
KMNRI

SEQ ID NO: 4029 - protein, 5 aa, Chlamydia trachomatis
MNRIW

SEQ ID NO: 4030 - protein, 5 aa, Chlamydia trachomatis
NRIWL

SEQ ID NO: 4031 - protein, 5 aa, Chlamydia trachomatis
RIWLL

SEQ ID NO: 4032 - protein, 5 aa, Chlamydia trachomatis
IWLLL

SEQ ID NO: 4033 - protein, 5 aa, Chlamydia trachomatis
WLLLL

SEQ ID NO: 4034 - protein, 5 aa, Chlamydia trachomatis
LLLLT

SEQ ID NO: 4035 - protein, 5 aa, Chlamydia trachomatis
LLLTF

SEQ ID NO: 4036 - protein, 5 aa, Chlamydia trachomatis
LLTFS

SEQ ID NO: 4037 - protein, 5 aa, Chlamydia trachomatis
LTFSS

SEQ ID NO: 4038 - protein, 5 aa, Chlamydia trachomatis
TFSSA

SEQ ID NO: 4039 - protein, 5 aa, Chlamydia trachomatis
FSSAI

SEQ ID NO: 4040 - protein, 5 aa, Chlamydia trachomatis
SSAIH

SEQ ID NO: 4041 - protein, 5 aa, Chlamydia trachomatis
SAIHS

SEQ ID NO: 4042 - protein, 5 aa, Chlamydia trachomatis
AIHSP

SEQ ID NO: 4043 - protein, 5 aa, Chlamydia trachomatis
IHSPV

SEQ ID NO: 4044 - protein, 5 aa, Chlamydia trachomatis
HSPVQ

SEQ ID NO: 4045 - protein, 5 aa, Chlamydia trachomatis
SPVQG

SEQ ID NO: 4046 - protein, 5 aa, Chlamydia trachomatis
PVQGE

SEQ ID NO: 4047 - protein, 5 aa, Chlamydia trachomatis
VQGES

SEQ ID NO: 4048 - protein, 5 aa, Chlamydia trachomatis
QGESL

SEQ ID NO: 4049 - protein, 5 aa, Chlamydia trachomatis
GESLV

SEQ ID NO: 4050 - protein, 5 aa, Chlamydia trachomatis
ESLVC

SEQ ID NO: 4051 - protein, 5 aa, Chlamydia trachomatis
SLVCK

SEQ ID NO: 4052 - protein, 5 aa, Chlamydia trachomatis
LVCKN

SEQ ID NO: 4053 - protein, 5 aa, Chlamydia trachomatis
VCKNA

SEQ ID NO: 4054 - protein, 5 aa, Chlamydia trachomatis
CKNAL

SEQ ID NO: 4055 - protein, 5 aa, Chlamydia trachomatis
KNALQ

SEQ ID NO: 4056 - protein, 5 aa, Chlamydia trachomatis
NALQD

SEQ ID NO: 4057 - protein, 5 aa, Chlamydia trachomatis
ALQDL

SEQ ID NO: 4058 - protein, 5 aa, Chlamydia trachomatis
LQDLS

SEQ ID NO: 4059 - protein, 5 aa, Chlamydia trachomatis
QDLSF

SEQ ID NO: 4060 - protein, 5 aa, Chlamydia trachomatis
DLSFL

SEQ ID NO: 4061 - protein, 5 aa, Chlamydia trachomatis
LSFLE

SEQ ID NO: 4062 - protein, 5 aa, Chlamydia trachomatis
SFLEH

SEQ ID NO: 4063 - protein, 5 aa, Chlamydia trachomatis
FLEHL

SEQ ID NO: 4064 - protein, 5 aa, Chlamydia trachomatis
LEHLL

SEQ ID NO: 4065 - protein, 5 aa, Chlamydia trachomatis
EHLLQ

SEQ ID NO: 4066 - protein, 5 aa, Chlamydia trachomatis
HLLQV

SEQ ID NO: 4067 - protein, 5 aa, Chlamydia trachomatis
LLQVK

SEQ ID NO: 4068 - protein, 5 aa, Chlamydia trachomatis
LQVKY

SEQ ID NO: 4069 - protein, 5 aa, Chlamydia trachomatis
QVKYA

SEQ ID NO: 4070 - protein, 5 aa, Chlamydia trachomatis
VKYAP

SEQ ID NO: 4071 - protein, 5 aa, Chlamydia trachomatis
KYAPK

SEQ ID NO: 4072 - protein, 5 aa, Chlamydia trachomatis
YAPKT

SEQ ID NO: 4073 - protein, 5 aa, Chlamydia trachomatis
APKTW

SEQ ID NO: 4074 - protein, 5 aa, Chlamydia trachomatis
PKTWK

SEQ ID NO: 4075 - protein, 5 aa, Chlamydia trachomatis
KTWKE

SEQ ID NO: 4076 - protein, 5 aa, Chlamydia trachomatis
TWKEQ

SEQ ID NO: 4077 - protein, 5 aa, Chlamydia trachomatis
WKEQY

SEQ ID NO: 4078 - protein, 5 aa, Chlamydia trachomatis
KEQYL

SEQ ID NO: 4079 - protein, 5 aa, Chlamydia trachomatis
EQYLG

SEQ ID NO: 4080 - protein, 5 aa, Chlamydia trachomatis
QYLGW

SEQ ID NO: 4081 - protein, 5 aa, Chlamydia trachomatis
YLGWD

SEQ ID NO: 4082 - protein, 5 aa, Chlamydia trachomatis
LGWDL

SEQ ID NO: 4083 - protein, 5 aa, Chlamydia trachomatis
GWDLV

SEQ ID NO: 4084 - protein, 5 aa, Chlamydia trachomatis
WDLVQ

SEQ ID NO: 4085 - protein, 5 aa, Chlamydia trachomatis
DLVQS

SEQ ID NO: 4086 - protein, 5 aa, Chlamydia trachomatis
LVQSS

SEQ ID NO: 4087 - protein, 5 aa, Chlamydia trachomatis
VQSSV

SEQ ID NO: 4088 - protein, 5 aa, Chlamydia trachomatis
QSSVS

SEQ ID NO: 4089 - protein, 5 aa, Chlamydia trachomatis
SSVSA

SEQ ID NO: 4090 - protein, 5 aa, Chlamydia trachomatis
SVSAQ

SEQ ID NO: 4091 - protein, 5 aa, Chlamydia trachomatis
VSAQQ

SEQ ID NO: 4092 - protein, 5 aa, Chlamydia trachomatis
SAQQK

SEQ ID NO: 4093 - protein, 5 aa, Chlamydia trachomatis
AQQKL

SEQ ID NO: 4094 - protein, 5 aa, Chlamydia trachomatis
QQKLR

SEQ ID NO: 4095 - protein, 5 aa, Chlamydia trachomatis
QKLRT

SEQ ID NO: 4096 - protein, 5 aa, Chlamydia trachomatis
KLRTQ

SEQ ID NO: 4097 - protein, 5 aa, Chlamydia trachomatis
LRTQE

SEQ ID NO: 4098 - protein, 5 aa, Chlamydia trachomatis
RTQEN

SEQ ID NO: 4099 - protein, 5 aa, Chlamydia trachomatis
TQENP

SEQ ID NO: 4100 - protein, 5 aa, Chlamydia trachomatis
QENPS

SEQ ID NO: 4101 - protein, 5 aa, Chlamydia trachomatis
ENPST

SEQ ID NO: 4102 - protein, 5 aa, Chlamydia trachomatis
NPSTS

SEQ ID NO: 4103 - protein, 5 aa, Chlamydia trachomatis
PSTSF

SEQ ID NO: 4104 - protein, 5 aa, Chlamydia trachomatis
STSFC

SEQ ID NO: 4105 - protein, 5 aa, Chlamydia trachomatis
TSFCQ

SEQ ID NO: 4106 - protein, 5 aa, Chlamydia trachomatis
SFCQQ

SEQ ID NO: 4107 - protein, 5 aa, Chlamydia trachomatis
FCQQV

SEQ ID NO: 4108 - protein, 5 aa, Chlamydia trachomatis
CQQVL

SEQ ID NO: 4109 - protein, 5 aa, Chlamydia trachomatis
QQVLA

SEQ ID NO: 4110 - protein, 5 aa, Chlamydia trachomatis
QVLAD

SEQ ID NO: 4111 - protein, 5 aa, Chlamydia trachomatis
VLADF

SEQ ID NO: 4112 - protein, 5 aa, Chlamydia trachomatis
LADFI

SEQ ID NO: 4113 - protein, 5 aa, Chlamydia trachomatis
ADFIG

SEQ ID NO: 4114 - protein, 5 aa, Chlamydia trachomatis
DFIGG

SEQ ID NO: 4115 - protein, 5 aa, Chlamydia trachomatis
FIGGL

SEQ ID NO: 4116 - protein, 5 aa, Chlamydia trachomatis
IGGLN

SEQ ID NO: 4117 - protein, 5 aa, Chlamydia trachomatis
GGLND

SEQ ID NO: 4118 - protein, 5 aa, Chlamydia trachomatis
GLNDF

SEQ ID NO: 4119 - protein, 5 aa, Chlamydia trachomatis
LNDFH

SEQ ID NO: 4120 - protein, 5 aa, Chlamydia trachomatis
NDFHA

SEQ ID NO: 4121 - protein, 5 aa, Chlamydia trachomatis
DFHAG

SEQ ID NO: 4122 - protein, 5 aa, Chlamydia trachomatis
FHAGV

SEQ ID NO: 4123 - protein, 5 aa, Chlamydia trachomatis
HAGVT

SEQ ID NO: 4124 - protein, 5 aa, Chlamydia trachomatis
AGVTF

SEQ ID NO: 4125 - protein, 5 aa, Chlamydia trachomatis
GVTFF

SEQ ID NO: 4126 - protein, 5 aa, Chlamydia trachomatis
VTFFA

SEQ ID NO: 4127 - protein, 5 aa, Chlamydia trachomatis
TFFAI

SEQ ID NO: 4128 - protein, 5 aa, Chlamydia trachomatis
FFAIE

SEQ ID NO: 4129 - protein, 5 aa, Chlamydia trachomatis
FAIES

SEQ ID NO: 4130 - protein, 5 aa, Chlamydia trachomatis
AIESA

SEQ ID NO: 4131 - protein, 5 aa, Chlamydia trachomatis
IESAY

SEQ ID NO: 4132 - protein, 5 aa, Chlamydia trachomatis
ESAYL

SEQ ID NO: 4133 - protein, 5 aa, Chlamydia trachomatis
SAYLP

SEQ ID NO: 4134 - protein, 5 aa, Chlamydia trachomatis
AYLPY

SEQ ID NO: 4135 - protein, 5 aa, Chlamydia trachomatis
YLPYT

SEQ ID NO: 4136 - protein, 5 aa, Chlamydia trachomatis
LPYTV

SEQ ID NO: 4137 - protein, 5 aa, Chlamydia trachomatis
PYTVQ

SEQ ID NO: 4138 - protein, 5 aa, Chlamydia trachomatis
YTVQK

SEQ ID NO: 4139 - protein, 5 aa, Chlamydia trachomatis
TVQKS

SEQ ID NO: 4140 - protein, 5 aa, Chlamydia trachomatis
VQKSS

SEQ ID NO: 4141 - protein, 5 aa, Chlamydia trachomatis
QKSSD

SEQ ID NO: 4142 - protein, 5 aa, Chlamydia trachomatis
KSSDG

SEQ ID NO: 4143 - protein, 5 aa, Chlamydia trachomatis
SSDGR

SEQ ID NO: 4144 - protein, 5 aa, Chlamydia trachomatis
SDGRF

SEQ ID NO: 4145 - protein, 5 aa, Chlamydia trachomatis
DGRFY

SEQ ID NO: 4146 - protein, 5 aa, Chlamydia trachomatis
GRFYF

SEQ ID NO: 4147 - protein, 5 aa, Chlamydia trachomatis
RFYFV

SEQ ID NO: 4148 - protein, 5 aa, Chlamydia trachomatis
FYFVD

SEQ ID NO: 4149 - protein, 5 aa, Chlamydia trachomatis
YFVDI

SEQ ID NO: 4150 - protein, 5 aa, Chlamydia trachomatis
FVDIM

SEQ ID NO: 4151 - protein, 5 aa, Chlamydia trachomatis
VDIMT

SEQ ID NO: 4152 - protein, 5 aa, Chlamydia trachomatis
DIMTF

SEQ ID NO: 4153 - protein, 5 aa, Chlamydia trachomatis
IMTFS

SEQ ID NO: 4154 - protein, 5 aa, Chlamydia trachomatis
MTFSS

SEQ ID NO: 4155 - protein, 5 aa, Chlamydia trachomatis
TFSSE

SEQ ID NO: 4156 - protein, 5 aa, Chlamydia trachomatis
FSSEI

SEQ ID NO: 4157 - protein, 5 aa, Chlamydia trachomatis
SSEIR

SEQ ID NO: 4158 - protein, 5 aa, Chlamydia trachomatis
SEIRV

SEQ ID NO: 4159 - protein, 5 aa, Chlamydia trachomatis
EIRVG

SEQ ID NO: 4160 - protein, 5 aa, Chlamydia trachomatis
IRVGD

SEQ ID NO: 4161 - protein, 5 aa, Chlamydia trachomatis
RVGDE

SEQ ID NO: 4162 - protein, 5 aa, Chlamydia trachomatis
VGDEL

SEQ ID NO: 4163 - protein, 5 aa, Chlamydia trachomatis
GDELL

SEQ ID NO: 4164 - protein, 5 aa, Chlamydia trachomatis
DELLE

SEQ ID NO: 4165 - protein, 5 aa, Chlamydia trachomatis
ELLEV

SEQ ID NO: 4166 - protein, 5 aa, Chlamydia trachomatis
LLEVD

SEQ ID NO: 4167 - protein, 5 aa, Chlamydia trachomatis
LEVDG

SEQ ID NO: 4168 - protein, 5 aa, Chlamydia trachomatis
EVDGA

SEQ ID NO: 4169 - protein, 5 aa, Chlamydia trachomatis
VDGAP

SEQ ID NO: 4170 - protein, 5 aa, Chlamydia trachomatis
DGAPV

SEQ ID NO: 4171 - protein, 5 aa, Chlamydia trachomatis
GAPVQ

SEQ ID NO: 4172 - protein, 5 aa, Chlamydia trachomatis
APVQD

SEQ ID NO: 4173 - protein, 5 aa, Chlamydia trachomatis
PVQDV

SEQ ID NO: 4174 - protein, 5 aa, Chlamydia trachomatis
VQDVL

SEQ ID NO: 4175 - protein, 5 aa, Chlamydia trachomatis
QDVLA

SEQ ID NO: 4176 - protein, 5 aa, Chlamydia trachomatis
DVLAT

SEQ ID NO: 4177 - protein, 5 aa, Chlamydia trachomatis
VLATL

SEQ ID NO: 4178 - protein, 5 aa, Chlamydia trachomatis
LATLY

SEQ ID NO: 4179 - protein, 5 aa, Chlamydia trachomatis
ATLYG

SEQ ID NO: 4180 - protein, 5 aa, Chlamydia trachomatis
TLYGS

SEQ ID NO: 4181 - protein, 5 aa, Chlamydia trachomatis
LYGSN

SEQ ID NO: 4182 - protein, 5 aa, Chlamydia trachomatis
YGSNH

SEQ ID NO: 4183 - protein, 5 aa, Chlamydia trachomatis
GSNHK

SEQ ID NO: 4184 - protein, 5 aa, Chlamydia trachomatis
SNHKG

SEQ ID NO: 4185 - protein, 5 aa, Chlamydia trachomatis
NHKGT

SEQ ID NO: 4186 - protein, 5 aa, Chlamydia trachomatis
HKGTA

SEQ ID NO: 4187 - protein, 5 aa, Chlamydia trachomatis
KGTAA

SEQ ID NO: 4188 - protein, 5 aa, Chlamydia trachomatis
GTAAE

SEQ ID NO: 4189 - protein, 5 aa, Chlamydia trachomatis
TAAEE

SEQ ID NO: 4190 - protein, 5 aa, Chlamydia trachomatis
AAEES

SEQ ID NO: 4191 - protein, 5 aa, Chlamydia trachomatis
AEESA

SEQ ID NO: 4192 - protein, 5 aa, Chlamydia trachomatis
EESAA

SEQ ID NO: 4193 - protein, 5 aa, Chlamydia trachomatis
ESAAL

SEQ ID NO: 4194 - protein, 5 aa, Chlamydia trachomatis
SAALR

SEQ ID NO: 4195 - protein, 5 aa, Chlamydia trachomatis
AALRT

SEQ ID NO: 4196 - protein, 5 aa, Chlamydia trachomatis
ALRTL

SEQ ID NO: 4197 - protein, 5 aa, Chlamydia trachomatis
LRTLF

SEQ ID NO: 4198 - protein, 5 aa, Chlamydia trachomatis
RTLFS

SEQ ID NO: 4199 - protein, 5 aa, Chlamydia trachomatis
TLFSR

SEQ ID NO: 4200 - protein, 5 aa, Chlamydia trachomatis
LFSRM

SEQ ID NO: 4201 - protein, 5 aa, Chlamydia trachomatis
FSRMA

SEQ ID NO: 4202 - protein, 5 aa, Chlamydia trachomatis
SRMAS

SEQ ID NO: 4203 - protein, 5 aa, Chlamydia trachomatis
RMASL

SEQ ID NO: 4204 - protein, 5 aa, Chlamydia trachomatis
MASLG

SEQ ID NO: 4205 - protein, 5 aa, Chlamydia trachomatis
ASLGH

SEQ ID NO: 4206 - protein, 5 aa, Chlamydia trachomatis
SLGHK

SEQ ID NO: 4207 - protein, 5 aa, Chlamydia trachomatis
LGHKV

SEQ ID NO: 4208 - protein, 5 aa, Chlamydia trachomatis
GHKVP

SEQ ID NO: 4209 - protein, 5 aa, Chlamydia trachomatis
HKVPS

SEQ ID NO: 4210 - protein, 5 aa, Chlamydia trachomatis
KVPSG

SEQ ID NO: 4211 - protein, 5 aa, Chlamydia trachomatis
VPSGR

SEQ ID NO: 4212 - protein, 5 aa, Chlamydia trachomatis
PSGRT

SEQ ID NO: 4213 - protein, 5 aa, Chlamydia trachomatis
SGRTT

SEQ ID NO: 4214 - protein, 5 aa, Chlamydia trachomatis
GRTTL

SEQ ID NO: 4215 - protein, 5 aa, Chlamydia trachomatis
RTTLK

SEQ ID NO: 4216 - protein, 5 aa, Chlamydia trachomatis
TTLKI

SEQ ID NO: 4217 - protein, 5 aa, Chlamydia trachomatis
TLKIR

SEQ ID NO: 4218 - protein, 5 aa, Chlamydia trachomatis
LKIRR

SEQ ID NO: 4219 - protein, 5 aa, Chlamydia trachomatis
KIRRP

SEQ ID NO: 4220 - protein, 5 aa, Chlamydia trachomatis
IRRPF

SEQ ID NO: 4221 - protein, 5 aa, Chlamydia trachomatis
RRPFG

SEQ ID NO: 4222 - protein, 5 aa, Chlamydia trachomatis
RPFGT

SEQ ID NO: 4223 - protein, 5 aa, Chlamydia trachomatis
PFGTT

SEQ ID NO: 4224 - protein, 5 aa, Chlamydia trachomatis
FGTTR

SEQ ID NO: 4225 - protein, 5 aa, Chlamydia trachomatis
GTTRE

SEQ ID NO: 4226 - protein, 5 aa, Chlamydia trachomatis
TTREV

SEQ ID NO: 4227 - protein, 5 aa, Chlamydia trachomatis
TREVR

SEQ ID NO: 4228 - protein, 5 aa, Chlamydia trachomatis
REVRV

SEQ ID NO: 4229 - protein, 5 aa, Chlamydia trachomatis
EVRVK

SEQ ID NO: 4230 - protein, 5 aa, Chlamydia trachomatis
VRVKW

SEQ ID NO: 4231 - protein, 5 aa, Chlamydia trachomatis
RVKWR

SEQ ID NO: 4232 - protein, 5 aa, Chlamydia trachomatis
VKWRY

SEQ ID NO: 4233 - protein, 5 aa, Chlamydia trachomatis
KWRYV

SEQ ID NO: 4234 - protein, 5 aa, Chlamydia trachomatis
WRYVP

SEQ ID NO: 4235 - protein, 5 aa, Chlamydia trachomatis
RYVPE

SEQ ID NO: 4236 - protein, 5 aa, Chlamydia trachomatis
YVPEG

SEQ ID NO: 4237 - protein, 5 aa, Chlamydia trachomatis
VPEGV

SEQ ID NO: 4238 - protein, 5 aa, Chlamydia trachomatis
PEGVG

SEQ ID NO: 4239 - protein, 5 aa, Chlamydia trachomatis
EGVGD

SEQ ID NO: 4240 - protein, 5 aa, Chlamydia trachomatis
GVGDL

SEQ ID NO: 4241 - protein, 5 aa, Chlamydia trachomatis
VGDLA

SEQ ID NO: 4242 - protein, 5 aa, Chlamydia trachomatis
GDLAT

SEQ ID NO: 4243 - protein, 5 aa, Chlamydia trachomatis
DLATI

SEQ ID NO: 4244 - protein, 5 aa, Chlamydia trachomatis
LATIA

SEQ ID NO: 4245 - protein, 5 aa, Chlamydia trachomatis
ATIAP

SEQ ID NO: 4246 - protein, 5 aa, Chlamydia trachomatis
TIAPS

SEQ ID NO: 4247 - protein, 5 aa, Chlamydia trachomatis
IAPSI

SEQ ID NO: 4248 - protein, 5 aa, Chlamydia trachomatis
APSIR

SEQ ID NO: 4249 - protein, 5 aa, Chlamydia trachomatis
PSIRA

SEQ ID NO: 4250 - protein, 5 aa, Chlamydia trachomatis
SIRAP

SEQ ID NO: 4251 - protein, 5 aa, Chlamydia trachomatis
IRAPQ

SEQ ID NO: 4252 - protein, 5 aa, Chlamydia trachomatis
RAPQL

SEQ ID NO: 4253 - protein, 5 aa, Chlamydia trachomatis
APQLQ

SEQ ID NO: 4254 - protein, 5 aa, Chlamydia trachomatis
PQLQK

SEQ ID NO: 4255 - protein, 5 aa, Chlamydia trachomatis
QLQKS

SEQ ID NO: 4256 - protein, 5 aa, Chlamydia trachomatis
LQKSM

SEQ ID NO: 4257 - protein, 5 aa, Chlamydia trachomatis
QKSMR

SEQ ID NO: 4258 - protein, 5 aa, Chlamydia trachomatis
KSMRS

SEQ ID NO: 4259 - protein, 5 aa, Chlamydia trachomatis
SMRSF

SEQ ID NO: 4260 - protein, 5 aa, Chlamydia trachomatis
MRSFF

SEQ ID NO: 4261 - protein, 5 aa, Chlamydia trachomatis
RSFFP

SEQ ID NO: 4262 - protein, 5 aa, Chlamydia trachomatis
SFFPK

SEQ ID NO: 4263 - protein, 5 aa, Chlamydia trachomatis
FFPKK

SEQ ID NO: 4264 - protein, 5 aa, Chlamydia trachomatis
FPKKD

SEQ ID NO: 4265 - protein, 5 aa, Chlamydia trachomatis
PKKDD

SEQ ID NO: 4266 - protein, 5 aa, Chlamydia trachomatis
KKDDA

SEQ ID NO: 4267 - protein, 5 aa, Chlamydia trachomatis
KDDAF

SEQ ID NO: 4268 - protein, 5 aa, Chlamydia trachomatis
DDAFH

SEQ ID NO: 4269 - protein, 5 aa, Chlamydia trachomatis
DAFHR

SEQ ID NO: 4270 - protein, 5 aa, Chlamydia trachomatis
AFHRS

SEQ ID NO: 4271 - protein, 5 aa, Chlamydia trachomatis
FHRSS

SEQ ID NO: 4272 - protein, 5 aa, Chlamydia trachomatis
HRSSS

SEQ ID NO: 4273 - protein, 5 aa, Chlamydia trachomatis
RSSSL

SEQ ID NO: 4274 - protein, 5 aa, Chlamydia trachomatis
SSSLF

SEQ ID NO: 4275 - protein, 5 aa, Chlamydia trachomatis
SSLFY

SEQ ID NO: 4276 - protein, 5 aa, Chlamydia trachomatis
SLFYS

SEQ ID NO: 4277 - protein, 5 aa, Chlamydia trachomatis
LFYSP

SEQ ID NO: 4278 - protein, 5 aa, Chlamydia trachomatis
FYSPM

SEQ ID NO: 4279 - protein, 5 aa, Chlamydia trachomatis
YSPMV

SEQ ID NO: 4280 - protein, 5 aa, Chlamydia trachomatis
SPMVP

SEQ ID NO: 4281 - protein, 5 aa, Chlamydia trachomatis
PMVPH

SEQ ID NO: 4282 - protein, 5 aa, Chlamydia trachomatis
MVPHF

SEQ ID NO: 4283 - protein, 5 aa, Chlamydia trachomatis
VPHFW

SEQ ID NO: 4284 - protein, 5 aa, Chlamydia trachomatis
PHFWA

SEQ ID NO: 4285 - protein, 5 aa, Chlamydia trachomatis
HFWAE

SEQ ID NO: 4286 - protein, 5 aa, Chlamydia trachomatis
FWAEL

SEQ ID NO: 4287 - protein, 5 aa, Chlamydia trachomatis
WAELR

SEQ ID NO: 4288 - protein, 5 aa, Chlamydia trachomatis
AELRN

SEQ ID NO: 4289 - protein, 5 aa, Chlamydia trachomatis
ELRNH

SEQ ID NO: 4290 - protein, 5 aa, Chlamydia trachomatis
LRNHY

SEQ ID NO: 4291 - protein, 5 aa, Chlamydia trachomatis
RNHYA

SEQ ID NO: 4292 - protein, 5 aa, Chlamydia trachomatis
NHYAT

SEQ ID NO: 4293 - protein, 5 aa, Chlamydia trachomatis
HYATS

SEQ ID NO: 4294 - protein, 5 aa, Chlamydia trachomatis
YATSG

SEQ ID NO: 4295 - protein, 5 aa, Chlamydia trachomatis
ATSGL

SEQ ID NO: 4296 - protein, 5 aa, Chlamydia trachomatis
TSGLK

SEQ ID NO: 4297 - protein, 5 aa, Chlamydia trachomatis
SGLKS

SEQ ID NO: 4298 - protein, 5 aa, Chlamydia trachomatis
GLKSG

SEQ ID NO: 4299 - protein, 5 aa, Chlamydia trachomatis
LKSGY

SEQ ID NO: 4300 - protein, 5 aa, Chlamydia trachomatis
KSGYN

SEQ ID NO: 4301 - protein, 5 aa, Chlamydia trachomatis
SGYNI

SEQ ID NO: 4302 - protein, 5 aa, Chlamydia trachomatis
GYNIG

SEQ ID NO: 4303 - protein, 5 aa, Chlamydia trachomatis
YNIGS

SEQ ID NO: 4304 - protein, 5 aa, Chlamydia trachomatis
NIGST

SEQ ID NO: 4305 - protein, 5 aa, Chlamydia trachomatis
IGSTD

SEQ ID NO: 4306 - protein, 5 aa, Chlamydia trachomatis
GSTDG

SEQ ID NO: 4307 - protein, 5 aa, Chlamydia trachomatis
STDGF

SEQ ID NO: 4308 - protein, 5 aa, Chlamydia trachomatis
TDGFL

SEQ ID NO: 4309 - protein, 5 aa, Chlamydia trachomatis
DGFLP

SEQ ID NO: 4310 - protein, 5 aa, Chlamydia trachomatis
GFLPV

SEQ ID NO: 4311 - protein, 5 aa, Chlamydia trachomatis
FLPVI

SEQ ID NO: 4312 - protein, 5 aa, Chlamydia trachomatis
LPVIG

SEQ ID NO: 4313 - protein, 5 aa, Chlamydia trachomatis
PVIGP

SEQ ID NO: 4314 - protein, 5 aa, Chlamydia trachomatis
VIGPV

SEQ ID NO: 4315 - protein, 5 aa, Chlamydia trachomatis
IGPVI

SEQ ID NO: 4316 - protein, 5 aa, Chlamydia trachomatis
GPVIW

SEQ ID NO: 4317 - protein, 5 aa, Chlamydia trachomatis
PVIWE

SEQ ID NO: 4318 - protein, 5 aa, Chlamydia trachomatis
VIWES

SEQ ID NO: 4319 - protein, 5 aa, Chlamydia trachomatis
IWESE

SEQ ID NO: 4320 - protein, 5 aa, Chlamydia trachomatis
WESEG

SEQ ID NO: 4321 - protein, 5 aa, Chlamydia trachomatis
ESEGL

SEQ ID NO: 4322 - protein, 5 aa, Chlamydia trachomatis
SEGLF

SEQ ID NO: 4323 - protein, 5 aa, Chlamydia trachomatis
EGLFR

SEQ ID NO: 4324 - protein, 5 aa, Chlamydia trachomatis
GLFRA

SEQ ID NO: 4325 - protein, 5 aa, Chlamydia trachomatis
LFRAY

SEQ ID NO: 4326 - protein, 5 aa, Chlamydia trachomatis
FRAYI

SEQ ID NO: 4327 - protein, 5 aa, Chlamydia trachomatis
RAYIS

SEQ ID NO: 4328 - protein, 5 aa, Chlamydia trachomatis
AYISS

SEQ ID NO: 4329 - protein, 5 aa, Chlamydia trachomatis
YISSV

SEQ ID NO: 4330 - protein, 5 aa, Chlamydia trachomatis
ISSVT

SEQ ID NO: 4331 - protein, 5 aa, Chlamydia trachomatis
SSVTD

SEQ ID NO: 4332 - protein, 5 aa, Chlamydia trachomatis
SVTDG

SEQ ID NO: 4333 - protein, 5 aa, Chlamydia trachomatis
VTDGD

SEQ ID NO: 4334 - protein, 5 aa, Chlamydia trachomatis
TDGDG

SEQ ID NO: 4335 - protein, 5 aa, Chlamydia trachomatis
DGDGK

SEQ ID NO: 4336 - protein, 5 aa, Chlamydia trachomatis
GDGKS

SEQ ID NO: 4337 - protein, 5 aa, Chlamydia trachomatis
DGKSH

SEQ ID NO: 4338 - protein, 5 aa, Chlamydia trachomatis
GKSHK

SEQ ID NO: 4339 - protein, 5 aa, Chlamydia trachomatis
KSHKV

SEQ ID NO: 4340 - protein, 5 aa, Chlamydia trachomatis
SHKVG

SEQ ID NO: 4341 - protein, 5 aa, Chlamydia trachomatis
HKVGF

SEQ ID NO: 4342 - protein, 5 aa, Chlamydia trachomatis
KVGFL

SEQ ID NO: 4343 - protein, 5 aa, Chlamydia trachomatis
VGFLR

SEQ ID NO: 4344 - protein, 5 aa, Chlamydia trachomatis
GFLRI

SEQ ID NO: 4345 - protein, 5 aa, Chlamydia trachomatis
FLRIP

SEQ ID NO: 4346 - protein, 5 aa, Chlamydia trachomatis
LRIPT

SEQ ID NO: 4347 - protein, 5 aa, Chlamydia trachomatis
RIPTY

SEQ ID NO: 4348 - protein, 5 aa, Chlamydia trachomatis
IPTYS

SEQ ID NO: 4349 - protein, 5 aa, Chlamydia trachomatis
PTYSW

SEQ ID NO: 4350 - protein, 5 aa, Chlamydia trachomatis
TYSWQ

SEQ ID NO: 4351 - protein, 5 aa, Chlamydia trachomatis
YSWQD

SEQ ID NO: 4352 - protein, 5 aa, Chlamydia trachomatis
SWQDM

SEQ ID NO: 4353 - protein, 5 aa, Chlamydia trachomatis
WQDME

SEQ ID NO: 4354 - protein, 5 aa, Chlamydia trachomatis
QDMED

SEQ ID NO: 4355 - protein, 5 aa, Chlamydia trachomatis
DMEDF

SEQ ID NO: 4356 - protein, 5 aa, Chlamydia trachomatis
MEDFD

SEQ ID NO: 4357 - protein, 5 aa, Chlamydia trachomatis
EDFDP

SEQ ID NO: 4358 - protein, 5 aa, Chlamydia trachomatis
DFDPS

SEQ ID NO: 4359 - protein, 5 aa, Chlamydia trachomatis
FDPSG

SEQ ID NO: 4360 - protein, 5 aa, Chlamydia trachomatis
DPSGP

SEQ ID NO: 4361 - protein, 5 aa, Chlamydia trachomatis
PSGPP

SEQ ID NO: 4362 - protein, 5 aa, Chlamydia trachomatis
SGPPP

SEQ ID NO: 4363 - protein, 5 aa, Chlamydia trachomatis
GPPPW

SEQ ID NO: 4364 - protein, 5 aa, Chlamydia trachomatis
PPPWE

SEQ ID NO: 4365 - protein, 5 aa, Chlamydia trachomatis
PPWEE

SEQ ID NO: 4366 - protein, 5 aa, Chlamydia trachomatis
PWEEF

SEQ ID NO: 4367 - protein, 5 aa, Chlamydia trachomatis
WEEFA

SEQ ID NO: 4368 - protein, 5 aa, Chlamydia trachomatis
EEFAK

SEQ ID NO: 4369 - protein, 5 aa, Chlamydia trachomatis
EFAKI

SEQ ID NO: 4370 - protein, 5 aa, Chlamydia trachomatis
FAKII

SEQ ID NO: 4371 - protein, 5 aa, Chlamydia trachomatis
AKIIQ

SEQ ID NO: 4372 - protein, 5 aa, Chlamydia trachomatis
KIIQV

SEQ ID NO: 4373 - protein, 5 aa, Chlamydia trachomatis
IIQVF

SEQ ID NO: 4374 - protein, 5 aa, Chlamydia trachomatis
IQVFS

SEQ ID NO: 4375 - protein, 5 aa, Chlamydia trachomatis
QVFSS

SEQ ID NO: 4376 - protein, 5 aa, Chlamydia trachomatis
VFSSN

SEQ ID NO: 4377 - protein, 5 aa, Chlamydia trachomatis
FSSNT

SEQ ID NO: 4378 - protein, 5 aa, Chlamydia trachomatis
SSNTE

SEQ ID NO: 4379 - protein, 5 aa, Chlamydia trachomatis
SNTEA

SEQ ID NO: 4380 - protein, 5 aa, Chlamydia trachomatis
NTEAL

SEQ ID NO: 4381 - protein, 5 aa, Chlamydia trachomatis
TEALI

SEQ ID NO: 4382 - protein, 5 aa, Chlamydia trachomatis
EALII

SEQ ID NO: 4383 - protein, 5 aa, Chlamydia trachomatis
ALIID

SEQ ID NO: 4384 - protein, 5 aa, Chlamydia trachomatis
LIIDQ

SEQ ID NO: 4385 - protein, 5 aa, Chlamydia trachomatis
IIDQT

SEQ ID NO: 4386 - protein, 5 aa, Chlamydia trachomatis
IDQTN

SEQ ID NO: 4387 - protein, 5 aa, Chlamydia trachomatis
DQTNN

SEQ ID NO: 4388 - protein, 5 aa, Chlamydia trachomatis
QTNNP

SEQ ID NO: 4389 - protein, 5 aa, Chlamydia trachomatis
TNNPG

SEQ ID NO: 4390 - protein, 5 aa, Chlamydia trachomatis
NNPGG

SEQ ID NO: 4391 - protein, 5 aa, Chlamydia trachomatis
NPGGS

SEQ ID NO: 4392 - protein, 5 aa, Chlamydia trachomatis
PGGSV

SEQ ID NO: 4393 - protein, 5 aa, Chlamydia trachomatis
GGSVL

SEQ ID NO: 4394 - protein, 5 aa, Chlamydia trachomatis
GSVLY

SEQ ID NO: 4395 - protein, 5 aa, Chlamydia trachomatis
SVLYL

SEQ ID NO: 4396 - protein, 5 aa, Chlamydia trachomatis
VLYLY

SEQ ID NO: 4397 - protein, 5 aa, Chlamydia trachomatis
LYLYA

SEQ ID NO: 4398 - protein, 5 aa, Chlamydia trachomatis
YLYAL

SEQ ID NO: 4399 - protein, 5 aa, Chlamydia trachomatis
LYALL

SEQ ID NO: 4400 - protein, 5 aa, Chlamydia trachomatis
YALLS

SEQ ID NO: 4401 - protein, 5 aa, Chlamydia trachomatis
ALLSM

SEQ ID NO: 4402 - protein, 5 aa, Chlamydia trachomatis
LLSML

SEQ ID NO: 4403 - protein, 5 aa, Chlamydia trachomatis
LSMLT

SEQ ID NO: 4404 - protein, 5 aa, Chlamydia trachomatis
SMLTD

SEQ ID NO: 4405 - protein, 5 aa, Chlamydia trachomatis
MLTDR

SEQ ID NO: 4406 - protein, 5 aa, Chlamydia trachomatis
LTDRP

SEQ ID NO: 4407 - protein, 5 aa, Chlamydia trachomatis
TDRPL

SEQ ID NO: 4408 - protein, 5 aa, Chlamydia trachomatis
DRPLE

SEQ ID NO: 4409 - protein, 5 aa, Chlamydia trachomatis
RPLEL

SEQ ID NO: 4410 - protein, 5 aa, Chlamydia trachomatis
PLELP

SEQ ID NO: 4411 - protein, 5 aa, Chlamydia trachomatis
LELPK

SEQ ID NO: 4412 - protein, 5 aa, Chlamydia trachomatis
ELPKH

SEQ ID NO: 4413 - protein, 5 aa, Chlamydia trachomatis
LPKHR

SEQ ID NO: 4414 - protein, 5 aa, Chlamydia trachomatis
PKHRM

SEQ ID NO: 4415 - protein, 5 aa, Chlamydia trachomatis
KHRMI

SEQ ID NO: 4416 - protein, 5 aa, Chlamydia trachomatis
HRMIL

SEQ ID NO: 4417 - protein, 5 aa, Chlamydia trachomatis
RMILT

SEQ ID NO: 4418 - protein, 5 aa, Chlamydia trachomatis
MILTQ

SEQ ID NO: 4419 - protein, 5 aa, Chlamydia trachomatis
ILTQD

SEQ ID NO: 4420 - protein, 5 aa, Chlamydia trachomatis
LTQDE

SEQ ID NO: 4421 - protein, 5 aa, Chlamydia trachomatis
TQDEV

SEQ ID NO: 4422 - protein, 5 aa, Chlamydia trachomatis
QDEVV

SEQ ID NO: 4423 - protein, 5 aa, Chlamydia trachomatis
DEVVD

SEQ ID NO: 4424 - protein, 5 aa, Chlamydia trachomatis
EVVDA

SEQ ID NO: 4425 - protein, 5 aa, Chlamydia trachomatis
VVDAL

SEQ ID NO: 4426 - protein, 5 aa, Chlamydia trachomatis
VDALD

SEQ ID NO: 4427 - protein, 5 aa, Chlamydia trachomatis
DALDW

SEQ ID NO: 4428 - protein, 5 aa, Chlamydia trachomatis
ALDWL

SEQ ID NO: 4429 - protein, 5 aa, Chlamydia trachomatis
LDWLT

SEQ ID NO: 4430 - protein, 5 aa, Chlamydia trachomatis
DWLTL

SEQ ID NO: 4431 - protein, 5 aa, Chlamydia trachomatis
WLTLL

SEQ ID NO: 4432 - protein, 5 aa, Chlamydia trachomatis
LTLLE

SEQ ID NO: 4433 - protein, 5 aa, Chlamydia trachomatis
TLLEN

SEQ ID NO: 4434 - protein, 5 aa, Chlamydia trachomatis
LLENV

SEQ ID NO: 4435 - protein, 5 aa, Chlamydia trachomatis
LENVD

SEQ ID NO: 4436 - protein, 5 aa, Chlamydia trachomatis
ENVDT

SEQ ID NO: 4437 - protein, 5 aa, Chlamydia trachomatis
NVDTN

SEQ ID NO: 4438 - protein, 5 aa, Chlamydia trachomatis
VDTNV

SEQ ID NO: 4439 - protein, 5 aa, Chlamydia trachomatis
DTNVE

SEQ ID NO: 4440 - protein, 5 aa, Chlamydia trachomatis
TNVES

SEQ ID NO: 4441 - protein, 5 aa, Chlamydia trachomatis
NVESR

SEQ ID NO: 4442 - protein, 5 aa, Chlamydia trachomatis
VESRL

SEQ ID NO: 4443 - protein, 5 aa, Chlamydia trachomatis
ESRLA

SEQ ID NO: 4444 - protein, 5 aa, Chlamydia trachomatis
SRLAL

SEQ ID NO: 4445 - protein, 5 aa, Chlamydia trachomatis
RLALG

SEQ ID NO: 4446 - protein, 5 aa, Chlamydia trachomatis
LALGD

SEQ ID NO: 4447 - protein, 5 aa, Chlamydia trachomatis
ALGDN

SEQ ID NO: 4448 - protein, 5 aa, Chlamydia trachomatis
LGDNM

SEQ ID NO: 4449 - protein, 5 aa, Chlamydia trachomatis
GDNME

SEQ ID NO: 4450 - protein, 5 aa, Chlamydia trachomatis
DNMEG

SEQ ID NO: 4451 - protein, 5 aa, Chlamydia trachomatis
NMEGY

SEQ ID NO: 4452 - protein, 5 aa, Chlamydia trachomatis
MEGYT

SEQ ID NO: 4453 - protein, 5 aa, Chlamydia trachomatis
EGYTV

SEQ ID NO: 4454 - protein, 5 aa, Chlamydia trachomatis
GYTVD

SEQ ID NO: 4455 - protein, 5 aa, Chlamydia trachomatis
YTVDL

SEQ ID NO: 4456 - protein, 5 aa, Chlamydia trachomatis
TVDLQ

SEQ ID NO: 4457 - protein, 5 aa, Chlamydia trachomatis
VDLQV

SEQ ID NO: 4458 - protein, 5 aa, Chlamydia trachomatis
DLQVA

SEQ ID NO: 4459 - protein, 5 aa, Chlamydia trachomatis
LQVAE

SEQ ID NO: 4460 - protein, 5 aa, Chlamydia trachomatis
QVAEY

SEQ ID NO: 4461 - protein, 5 aa, Chlamydia trachomatis
VAEYL

SEQ ID NO: 4462 - protein, 5 aa, Chlamydia trachomatis
AEYLK

SEQ ID NO: 4463 - protein, 5 aa, Chlamydia trachomatis
EYLKS

SEQ ID NO: 4464 - protein, 5 aa, Chlamydia trachomatis
YLKSF

SEQ ID NO: 4465 - protein, 5 aa, Chlamydia trachomatis
LKSFG

SEQ ID NO: 4466 - protein, 5 aa, Chlamydia trachomatis
KSFGR

SEQ ID NO: 4467 - protein, 5 aa, Chlamydia trachomatis
SFGRQ

SEQ ID NO: 4468 - protein, 5 aa, Chlamydia trachomatis
FGRQV

SEQ ID NO: 4469 - protein, 5 aa, Chlamydia trachomatis
GRQVL

SEQ ID NO: 4470 - protein, 5 aa, Chlamydia trachomatis
RQVLN

SEQ ID NO: 4471 - protein, 5 aa, Chlamydia trachomatis
QVLNC

SEQ ID NO: 4472 - protein, 5 aa, Chlamydia trachomatis
VLNCW

SEQ ID NO: 4473 - protein, 5 aa, Chlamydia trachomatis
LNCWS

SEQ ID NO: 4474 - protein, 5 aa, Chlamydia trachomatis
NCWSK

SEQ ID NO: 4475 - protein, 5 aa, Chlamydia trachomatis
CWSKG

SEQ ID NO: 4476 - protein, 5 aa, Chlamydia trachomatis
WSKGD

SEQ ID NO: 4477 - protein, 5 aa, Chlamydia trachomatis
SKGDI

SEQ ID NO: 4478 - protein, 5 aa, Chlamydia trachomatis
KGDIE

SEQ ID NO: 4479 - protein, 5 aa, Chlamydia trachomatis
GDIEL

SEQ ID NO: 4480 - protein, 5 aa, Chlamydia trachomatis
DIELS

SEQ ID NO: 4481 - protein, 5 aa, Chlamydia trachomatis
IELST

SEQ ID NO: 4482 - protein, 5 aa, Chlamydia trachomatis
ELSTP

SEQ ID NO: 4483 - protein, 5 aa, Chlamydia trachomatis
LSTPI

SEQ ID NO: 4484 - protein, 5 aa, Chlamydia trachomatis
STPIP

SEQ ID NO: 4485 - protein, 5 aa, Chlamydia trachomatis
TPIPL

SEQ ID NO: 4486 - protein, 5 aa, Chlamydia trachomatis
PIPLF

SEQ ID NO: 4487 - protein, 5 aa, Chlamydia trachomatis
IPLFG

SEQ ID NO: 4488 - protein, 5 aa, Chlamydia trachomatis
PLFGF

SEQ ID NO: 4489 - protein, 5 aa, Chlamydia trachomatis
LFGFE

SEQ ID NO: 4490 - protein, 5 aa, Chlamydia trachomatis
FGFEK

SEQ ID NO: 4491 - protein, 5 aa, Chlamydia trachomatis
GFEKI

SEQ ID NO: 4492 - protein, 5 aa, Chlamydia trachomatis
FEKIH

SEQ ID NO: 4493 - protein, 5 aa, Chlamydia trachomatis
EKIHP

SEQ ID NO: 4494 - protein, 5 aa, Chlamydia trachomatis
KIHPH

SEQ ID NO: 4495 - protein, 5 aa, Chlamydia trachomatis
IHPHP

SEQ ID NO: 4496 - protein, 5 aa, Chlamydia trachomatis
HPHPR

SEQ ID NO: 4497 - protein, 5 aa, Chlamydia trachomatis
PHPRV

SEQ ID NO: 4498 - protein, 5 aa, Chlamydia trachomatis
HPRVQ

SEQ ID NO: 4499 - protein, 5 aa, Chlamydia trachomatis
PRVQY

SEQ ID NO: 4500 - protein, 5 aa, Chlamydia trachomatis
RVQYS

SEQ ID NO: 4501 - protein, 5 aa, Chlamydia trachomatis
VQYSK

SEQ ID NO: 4502 - protein, 5 aa, Chlamydia trachomatis
QYSKP

SEQ ID NO: 4503 - protein, 5 aa, Chlamydia trachomatis
YSKPI

SEQ ID NO: 4504 - protein, 5 aa, Chlamydia trachomatis
SKPIC

SEQ ID NO: 4505 - protein, 5 aa, Chlamydia trachomatis
KPICV

SEQ ID NO: 4506 - protein, 5 aa, Chlamydia trachomatis
PICVL

SEQ ID NO: 4507 - protein, 5 aa, Chlamydia trachomatis
ICVLI

SEQ ID NO: 4508 - protein, 5 aa, Chlamydia trachomatis
CVLIN

SEQ ID NO: 4509 - protein, 5 aa, Chlamydia trachomatis
VLINE

SEQ ID NO: 4510 - protein, 5 aa, Chlamydia trachomatis
LINEQ

SEQ ID NO: 4511 - protein, 5 aa, Chlamydia trachomatis
INEQD

SEQ ID NO: 4512 - protein, 5 aa, Chlamydia trachomatis
NEQDF

SEQ ID NO: 4513 - protein, 5 aa, Chlamydia trachomatis
EQDFS

SEQ ID NO: 4514 - protein, 5 aa, Chlamydia trachomatis
QDFSC

SEQ ID NO: 4515 - protein, 5 aa, Chlamydia trachomatis
DFSCA

SEQ ID NO: 4516 - protein, 5 aa, Chlamydia trachomatis
FSCAD

SEQ ID NO: 4517 - protein, 5 aa, Chlamydia trachomatis
SCADF

SEQ ID NO: 4518 - protein, 5 aa, Chlamydia trachomatis
CADFF

SEQ ID NO: 4519 - protein, 5 aa, Chlamydia trachomatis
ADFFP

SEQ ID NO: 4520 - protein, 5 aa, Chlamydia trachomatis
DFFPV

SEQ ID NO: 4521 - protein, 5 aa, Chlamydia trachomatis
FFPVV

SEQ ID NO: 4522 - protein, 5 aa, Chlamydia trachomatis
FPVVL

SEQ ID NO: 4523 - protein, 5 aa, Chlamydia trachomatis
PVVLK

SEQ ID NO: 4524 - protein, 5 aa, Chlamydia trachomatis
VVLKD

SEQ ID NO: 4525 - protein, 5 aa, Chlamydia trachomatis
VLKDN

SEQ ID NO: 4526 - protein, 5 aa, Chlamydia trachomatis
LKDND

SEQ ID NO: 4527 - protein, 5 aa, Chlamydia trachomatis
KDNDR

SEQ ID NO: 4528 - protein, 5 aa, Chlamydia trachomatis
DNDRA

SEQ ID NO: 4529 - protein, 5 aa, Chlamydia trachomatis
NDRAL

SEQ ID NO: 4530 - protein, 5 aa, Chlamydia trachomatis
DRALI

SEQ ID NO: 4531 - protein, 5 aa, Chlamydia trachomatis
RALIV

SEQ ID NO: 4532 - protein, 5 aa, Chlamydia trachomatis
ALIVG

SEQ ID NO: 4533 - protein, 5 aa, Chlamydia trachomatis
LIVGT

SEQ ID NO: 4534 - protein, 5 aa, Chlamydia trachomatis
IVGTR

SEQ ID NO: 4535 - protein, 5 aa, Chlamydia trachomatis
VGTRT

SEQ ID NO: 4536 - protein, 5 aa, Chlamydia trachomatis
GTRTA

SEQ ID NO: 4537 - protein, 5 aa, Chlamydia trachomatis
TRTAG

SEQ ID NO: 4538 - protein, 5 aa, Chlamydia trachomatis
RTAGA

SEQ ID NO: 4539 - protein, 5 aa, Chlamydia trachomatis
TAGAG

SEQ ID NO: 4540 - protein, 5 aa, Chlamydia trachomatis
AGAGG

SEQ ID NO: 4541 - protein, 5 aa, Chlamydia trachomatis
GAGGF

SEQ ID NO: 4542 - protein, 5 aa, Chlamydia trachomatis
AGGFV

SEQ ID NO: 4543 - protein, 5 aa, Chlamydia trachomatis
GGFVF

SEQ ID NO: 4544 - protein, 5 aa, Chlamydia trachomatis
GFVFN

SEQ ID NO: 4545 - protein, 5 aa, Chlamydia trachomatis
FVFNV

SEQ ID NO: 4546 - protein, 5 aa, Chlamydia trachomatis
VFNVQ

SEQ ID NO: 4547 - protein, 5 aa, Chlamydia trachomatis
FNVQF

SEQ ID NO: 4548 - protein, 5 aa, Chlamydia trachomatis
NVQFP

SEQ ID NO: 4549 - protein, 5 aa, Chlamydia trachomatis
VQFPN

SEQ ID NO: 4550 - protein, 5 aa, Chlamydia trachomatis
QFPNR

SEQ ID NO: 4551 - protein, 5 aa, Chlamydia trachomatis
FPNRT

SEQ ID NO: 4552 - protein, 5 aa, Chlamydia trachomatis
PNRTG

SEQ ID NO: 4553 - protein, 5 aa, Chlamydia trachomatis
NRTGI

SEQ ID NO: 4554 - protein, 5 aa, Chlamydia trachomatis
RTGIK

SEQ ID NO: 4555 - protein, 5 aa, Chlamydia trachomatis
TGIKT

SEQ ID NO: 4556 - protein, 5 aa, Chlamydia trachomatis
GIKTC

SEQ ID NO: 4557 - protein, 5 aa, Chlamydia trachomatis
IKTCS

SEQ ID NO: 4558 - protein, 5 aa, Chlamydia trachomatis
KTCSL

SEQ ID NO: 4559 - protein, 5 aa, Chlamydia trachomatis
TCSLT

SEQ ID NO: 4560 - protein, 5 aa, Chlamydia trachomatis
CSLTG

SEQ ID NO: 4561 - protein, 5 aa, Chlamydia trachomatis
SLTGS

SEQ ID NO: 4562 - protein, 5 aa, Chlamydia trachomatis
LTGSL

SEQ ID NO: 4563 - protein, 5 aa, Chlamydia trachomatis
TGSLA

SEQ ID NO: 4564 - protein, 5 aa, Chlamydia trachomatis
GSLAV

SEQ ID NO: 4565 - protein, 5 aa, Chlamydia trachomatis
SLAVR

SEQ ID NO: 4566 - protein, 5 aa, Chlamydia trachomatis
LAVRE

SEQ ID NO: 4567 - protein, 5 aa, Chlamydia trachomatis
AVREH

SEQ ID NO: 4568 - protein, 5 aa, Chlamydia trachomatis
VREHG

SEQ ID NO: 4569 - protein, 5 aa, Chlamydia trachomatis
REHGA

SEQ ID NO: 4570 - protein, 5 aa, Chlamydia trachomatis
EHGAF

SEQ ID NO: 4571 - protein, 5 aa, Chlamydia trachomatis
HGAFI

SEQ ID NO: 4572 - protein, 5 aa, Chlamydia trachomatis
GAFIE

SEQ ID NO: 4573 - protein, 5 aa, Chlamydia trachomatis
AFIEN

SEQ ID NO: 4574 - protein, 5 aa, Chlamydia trachomatis
FIENI

SEQ ID NO: 4575 - protein, 5 aa, Chlamydia trachomatis
IENIG

SEQ ID NO: 4576 - protein, 5 aa, Chlamydia trachomatis
ENIGV

SEQ ID NO: 4577 - protein, 5 aa, Chlamydia trachomatis
NIGVE

SEQ ID NO: 4578 - protein, 5 aa, Chlamydia trachomatis
IGVEP

SEQ ID NO: 4579 - protein, 5 aa, Chlamydia trachomatis
GVEPH

SEQ ID NO: 4580 - protein, 5 aa, Chlamydia trachomatis
VEPHI

SEQ ID NO: 4581 - protein, 5 aa, Chlamydia trachomatis
EPHID

SEQ ID NO: 4582 - protein, 5 aa, Chlamydia trachomatis
PHIDL

SEQ ID NO: 4583 - protein, 5 aa, Chlamydia trachomatis
HIDLP

SEQ ID NO: 4584 - protein, 5 aa, Chlamydia trachomatis
IDLPF

SEQ ID NO: 4585 - protein, 5 aa, Chlamydia trachomatis
DLPFT

SEQ ID NO: 4586 - protein, 5 aa, Chlamydia trachomatis
LPFTA

SEQ ID NO: 4587 - protein, 5 aa, Chlamydia trachomatis
PFTAN

SEQ ID NO: 4588 - protein, 5 aa, Chlamydia trachomatis
FTAND

SEQ ID NO: 4589 - protein, 5 aa, Chlamydia trachomatis
TANDI

SEQ ID NO: 4590 - protein, 5 aa, Chlamydia trachomatis
ANDIR

SEQ ID NO: 4591 - protein, 5 aa, Chlamydia trachomatis
NDIRY

SEQ ID NO: 4592 - protein, 5 aa, Chlamydia trachomatis
DIRYK

SEQ ID NO: 4593 - protein, 5 aa, Chlamydia trachomatis
IRYKG

SEQ ID NO: 4594 - protein, 5 aa, Chlamydia trachomatis
RYKGY

SEQ ID NO: 4595 - protein, 5 aa, Chlamydia trachomatis
YKGYS

SEQ ID NO: 4596 - protein, 5 aa, Chlamydia trachomatis
KGYSE

SEQ ID NO: 4597 - protein, 5 aa, Chlamydia trachomatis
GYSEY

SEQ ID NO: 4598 - protein, 5 aa, Chlamydia trachomatis
YSEYL

SEQ ID NO: 4599 - protein, 5 aa, Chlamydia trachomatis
SEYLD

SEQ ID NO: 4600 - protein, 5 aa, Chlamydia trachomatis
EYLDK

SEQ ID NO: 4601 - protein, 5 aa, Chlamydia trachomatis
YLDKV

SEQ ID NO: 4602 - protein, 5 aa, Chlamydia trachomatis
LDKVK

SEQ ID NO: 4603 - protein, 5 aa, Chlamydia trachomatis
DKVKK

SEQ ID NO: 4604 - protein, 5 aa, Chlamydia trachomatis
KVKKL

SEQ ID NO: 4605 - protein, 5 aa, Chlamydia trachomatis
VKKLV

SEQ ID NO: 4606 - protein, 5 aa, Chlamydia trachomatis
KKLVC

SEQ ID NO: 4607 - protein, 5 aa, Chlamydia trachomatis
KLVCQ

SEQ ID NO: 4608 - protein, 5 aa, Chlamydia trachomatis
LVCQL

SEQ ID NO: 4609 - protein, 5 aa, Chlamydia trachomatis
VCQLI

SEQ ID NO: 4610 - protein, 5 aa, Chlamydia trachomatis
CQLIN

SEQ ID NO: 4611 - protein, 5 aa, Chlamydia trachomatis
QLINN

SEQ ID NO: 4612 - protein, 5 aa, Chlamydia trachomatis
LINND

SEQ ID NO: 4613 - protein, 5 aa, Chlamydia trachomatis
INNDG

SEQ ID NO: 4614 - protein, 5 aa, Chlamydia trachomatis
NNDGT

SEQ ID NO: 4615 - protein, 5 aa, Chlamydia trachomatis
NDGTI

SEQ ID NO: 4616 - protein, 5 aa, Chlamydia trachomatis
DGTII

SEQ ID NO: 4617 - protein, 5 aa, Chlamydia trachomatis
GTIIL

SEQ ID NO: 4618 - protein, 5 aa, Chlamydia trachomatis
TIILA

SEQ ID NO: 4619 - protein, 5 aa, Chlamydia trachomatis
IILAE

SEQ ID NO: 4620 - protein, 5 aa, Chlamydia trachomatis
ILAED

SEQ ID NO: 4621 - protein, 5 aa, Chlamydia trachomatis
LAEDG

SEQ ID NO: 4622 - protein, 5 aa, Chlamydia trachomatis
AEDGS

SEQ ID NO: 4623 - protein, 5 aa, Chlamydia trachomatis
EDGSF

SEQ ID NO: 4624 - protein, 5 aa, Chlamydia trachomatis
MGNSG

SEQ ID NO: 4625 - protein, 5 aa, Chlamydia trachomatis
GNSGF

SEQ ID NO: 4626 - protein, 5 aa, Chlamydia trachomatis
NSGFY

SEQ ID NO: 4627 - protein, 5 aa, Chlamydia trachomatis
SGFYL

SEQ ID NO: 4628 - protein, 5 aa, Chlamydia trachomatis
GFYLY

SEQ ID NO: 4629 - protein, 5 aa, Chlamydia trachomatis
FYLYN

SEQ ID NO: 4630 - protein, 5 aa, Chlamydia trachomatis
YLYNT

SEQ ID NO: 4631 - protein, 5 aa, Chlamydia trachomatis
LYNTE

SEQ ID NO: 4632 - protein, 5 aa, Chlamydia trachomatis
YNTEN

SEQ ID NO: 4633 - protein, 5 aa, Chlamydia trachomatis
NTENC

SEQ ID NO: 4634 - protein, 5 aa, Chlamydia trachomatis
TENCV

SEQ ID NO: 4635 - protein, 5 aa, Chlamydia trachomatis
ENCVF

SEQ ID NO: 4636 - protein, 5 aa, Chlamydia trachomatis
NCVFA

SEQ ID NO: 4637 - protein, 5 aa, Chlamydia trachomatis
CVFAD

SEQ ID NO: 4638 - protein, 5 aa, Chlamydia trachomatis
VFADN

SEQ ID NO: 4639 - protein, 5 aa, Chlamydia trachomatis
FADNI

SEQ ID NO: 4640 - protein, 5 aa, Chlamydia trachomatis
ADNIK

SEQ ID NO: 4641 - protein, 5 aa, Chlamydia trachomatis
DNIKV

SEQ ID NO: 4642 - protein, 5 aa, Chlamydia trachomatis
NIKVG

SEQ ID NO: 4643 - protein, 5 aa, Chlamydia trachomatis
IKVGQ

SEQ ID NO: 4644 - protein, 5 aa, Chlamydia trachomatis
KVGQM

SEQ ID NO: 4645 - protein, 5 aa, Chlamydia trachomatis
VGQMT

SEQ ID NO: 4646 - protein, 5 aa, Chlamydia trachomatis
GQMTE

SEQ ID NO: 4647 - protein, 5 aa, Chlamydia trachomatis
QMTEP

SEQ ID NO: 4648 - protein, 5 aa, Chlamydia trachomatis
MTEPL

SEQ ID NO: 4649 - protein, 5 aa, Chlamydia trachomatis
TEPLK

SEQ ID NO: 4650 - protein, 5 aa, Chlamydia trachomatis
EPLKD

SEQ ID NO: 4651 - protein, 5 aa, Chlamydia trachomatis
PLKDQ

SEQ ID NO: 4652 - protein, 5 aa, Chlamydia trachomatis
LKDQQ

SEQ ID NO: 4653 - protein, 5 aa, Chlamydia trachomatis
KDQQI

SEQ ID NO: 4654 - protein, 5 aa, Chlamydia trachomatis
DQQII

SEQ ID NO: 4655 - protein, 5 aa, Chlamydia trachomatis
QQIIL

SEQ ID NO: 4656 - protein, 5 aa, Chlamydia trachomatis
QIILG

SEQ ID NO: 4657 - protein, 5 aa, Chlamydia trachomatis
IILGT

SEQ ID NO: 4658 - protein, 5 aa, Chlamydia trachomatis
ILGTK

SEQ ID NO: 4659 - protein, 5 aa, Chlamydia trachomatis
LGTKS

SEQ ID NO: 4660 - protein, 5 aa, Chlamydia trachomatis
GTKST

SEQ ID NO: 4661 - protein, 5 aa, Chlamydia trachomatis
TKSTP

SEQ ID NO: 4662 - protein, 5 aa, Chlamydia trachomatis
KSTPV

SEQ ID NO: 4663 - protein, 5 aa, Chlamydia trachomatis
STPVA

SEQ ID NO: 4664 - protein, 5 aa, Chlamydia trachomatis
TPVAA

SEQ ID NO: 4665 - protein, 5 aa, Chlamydia trachomatis
PVAAK

SEQ ID NO: 4666 - protein, 5 aa, Chlamydia trachomatis
VAAKM

SEQ ID NO: 4667 - protein, 5 aa, Chlamydia trachomatis
AAKMT

SEQ ID NO: 4668 - protein, 5 aa, Chlamydia trachomatis
AKMTA

SEQ ID NO: 4669 - protein, 5 aa, Chlamydia trachomatis
KMTAS

SEQ ID NO: 4670 - protein, 5 aa, Chlamydia trachomatis
MTASD

SEQ ID NO: 4671 - protein, 5 aa, Chlamydia trachomatis
TASDG

SEQ ID NO: 4672 - protein, 5 aa, Chlamydia trachomatis
ASDGI

SEQ ID NO: 4673 - protein, 5 aa, Chlamydia trachomatis
SDGIS

SEQ ID NO: 4674 - protein, 5 aa, Chlamydia trachomatis
DGISL

SEQ ID NO: 4675 - protein, 5 aa, Chlamydia trachomatis
GISLT

SEQ ID NO: 4676 - protein, 5 aa, Chlamydia trachomatis
ISLTV

SEQ ID NO: 4677 - protein, 5 aa, Chlamydia trachomatis
SLTVS

SEQ ID NO: 4678 - protein, 5 aa, Chlamydia trachomatis
LTVSN

SEQ ID NO: 4679 - protein, 5 aa, Chlamydia trachomatis
TVSNN

SEQ ID NO: 4680 - protein, 5 aa, Chlamydia trachomatis
VSNNS

SEQ ID NO: 4681 - protein, 5 aa, Chlamydia trachomatis
SNNSS

SEQ ID NO: 4682 - protein, 5 aa, Chlamydia trachomatis
NNSST

SEQ ID NO: 4683 - protein, 5 aa, Chlamydia trachomatis
NSSTN

SEQ ID NO: 4684 - protein, 5 aa, Chlamydia trachomatis
SSTNA

SEQ ID NO: 4685 - protein, 5 aa, Chlamydia trachomatis
STNAS

SEQ ID NO: 4686 - protein, 5 aa, Chlamydia trachomatis
TNASI

SEQ ID NO: 4687 - protein, 5 aa, Chlamydia trachomatis
NASIT

SEQ ID NO: 4688 - protein, 5 aa, Chlamydia trachomatis
ASITI

SEQ ID NO: 4689 - protein, 5 aa, Chlamydia trachomatis
SITIG

SEQ ID NO: 4690 - protein, 5 aa, Chlamydia trachomatis
ITIGL

SEQ ID NO: 4691 - protein, 5 aa, Chlamydia trachomatis
TIGLD

SEQ ID NO: 4692 - protein, 5 aa, Chlamydia trachomatis
IGLDA

SEQ ID NO: 4693 - protein, 5 aa, Chlamydia trachomatis
GLDAE

SEQ ID NO: 4694 - protein, 5 aa, Chlamydia trachomatis
LDAEK

SEQ ID NO: 4695 - protein, 5 aa, Chlamydia trachomatis
DAEKA

SEQ ID NO: 4696 - protein, 5 aa, Chlamydia trachomatis
AEKAY

SEQ ID NO: 4697 - protein, 5 aa, Chlamydia trachomatis
EKAYQ

SEQ ID NO: 4698 - protein, 5 aa, Chlamydia trachomatis
KAYQL

SEQ ID NO: 4699 - protein, 5 aa, Chlamydia trachomatis
AYQLI

SEQ ID NO: 4700 - protein, 5 aa, Chlamydia trachomatis
YQLIL

SEQ ID NO: 4701 - protein, 5 aa, Chlamydia trachomatis
QLILE

SEQ ID NO: 4702 - protein, 5 aa, Chlamydia trachomatis
LILEK

SEQ ID NO: 4703 - protein, 5 aa, Chlamydia trachomatis
ILEKL

SEQ ID NO: 4704 - protein, 5 aa, Chlamydia trachomatis
LEKLG

SEQ ID NO: 4705 - protein, 5 aa, Chlamydia trachomatis
EKLGN

SEQ ID NO: 4706 - protein, 5 aa, Chlamydia trachomatis
KLGNQ

SEQ ID NO: 4707 - protein, 5 aa, Chlamydia trachomatis
LGNQI

SEQ ID NO: 4708 - protein, 5 aa, Chlamydia trachomatis
GNQIL

SEQ ID NO: 4709 - protein, 5 aa, Chlamydia trachomatis
NQILD

SEQ ID NO: 4710 - protein, 5 aa, Chlamydia trachomatis
QILDG

SEQ ID NO: 4711 - protein, 5 aa, Chlamydia trachomatis
ILDGI

SEQ ID NO: 4712 - protein, 5 aa, Chlamydia trachomatis
LDGIA

SEQ ID NO: 4713 - protein, 5 aa, Chlamydia trachomatis
DGIAD

SEQ ID NO: 4714 - protein, 5 aa, Chlamydia trachomatis
GIADT

SEQ ID NO: 4715 - protein, 5 aa, Chlamydia trachomatis
IADTI

SEQ ID NO: 4716 - protein, 5 aa, Chlamydia trachomatis
ADTIV

SEQ ID NO: 4717 - protein, 5 aa, Chlamydia trachomatis
DTIVD

SEQ ID NO: 4718 - protein, 5 aa, Chlamydia trachomatis
TIVDS

SEQ ID NO: 4719 - protein, 5 aa, Chlamydia trachomatis
IVDST

SEQ ID NO: 4720 - protein, 5 aa, Chlamydia trachomatis
VDSTV

SEQ ID NO: 4721 - protein, 5 aa, Chlamydia trachomatis
DSTVQ

SEQ ID NO: 4722 - protein, 5 aa, Chlamydia trachomatis
STVQD

SEQ ID NO: 4723 - protein, 5 aa, Chlamydia trachomatis
TVQDI

SEQ ID NO: 4724 - protein, 5 aa, Chlamydia trachomatis
VQDIL

SEQ ID NO: 4725 - protein, 5 aa, Chlamydia trachomatis
QDILD

SEQ ID NO: 4726 - protein, 5 aa, Chlamydia trachomatis
DILDK

SEQ ID NO: 4727 - protein, 5 aa, Chlamydia trachomatis
ILDKI

SEQ ID NO: 4728 - protein, 5 aa, Chlamydia trachomatis
LDKIT

SEQ ID NO: 4729 - protein, 5 aa, Chlamydia trachomatis
DKITT

SEQ ID NO: 4730 - protein, 5 aa, Chlamydia trachomatis
KITTD

SEQ ID NO: 4731 - protein, 5 aa, Chlamydia trachomatis
ITTDP

SEQ ID NO: 4732 - protein, 5 aa, Chlamydia trachomatis
TTDPS

SEQ ID NO: 4733 - protein, 5 aa, Chlamydia trachomatis
TDPSL

SEQ ID NO: 4734 - protein, 5 aa, Chlamydia trachomatis
DPSLG

SEQ ID NO: 4735 - protein, 5 aa, Chlamydia trachomatis
PSLGL

SEQ ID NO: 4736 - protein, 5 aa, Chlamydia trachomatis
SLGLL

SEQ ID NO: 4737 - protein, 5 aa, Chlamydia trachomatis
LGLLK

SEQ ID NO: 4738 - protein, 5 aa, Chlamydia trachomatis
GLLKA

SEQ ID NO: 4739 - protein, 5 aa, Chlamydia trachomatis
LLKAF

SEQ ID NO: 4740 - protein, 5 aa, Chlamydia trachomatis
LKAFN

SEQ ID NO: 4741 - protein, 5 aa, Chlamydia trachomatis
KAFNN

SEQ ID NO: 4742 - protein, 5 aa, Chlamydia trachomatis
AFNNF

SEQ ID NO: 4743 - protein, 5 aa, Chlamydia trachomatis
FNNFP

SEQ ID NO: 4744 - protein, 5 aa, Chlamydia trachomatis
NNFPI

SEQ ID NO: 4745 - protein, 5 aa, Chlamydia trachomatis
NFPIT

SEQ ID NO: 4746 - protein, 5 aa, Chlamydia trachomatis
FPITN

SEQ ID NO: 4747 - protein, 5 aa, Chlamydia trachomatis
PITNK

SEQ ID NO: 4748 - protein, 5 aa, Chlamydia trachomatis
ITNKI

SEQ ID NO: 4749 - protein, 5 aa, Chlamydia trachomatis
TNKIQ

SEQ ID NO: 4750 - protein, 5 aa, Chlamydia trachomatis
NKIQC

SEQ ID NO: 4751 - protein, 5 aa, Chlamydia trachomatis
KIQCN

SEQ ID NO: 4752 - protein, 5 aa, Chlamydia trachomatis
IQCNG

SEQ ID NO: 4753 - protein, 5 aa, Chlamydia trachomatis
QCNGL

SEQ ID NO: 4754 - protein, 5 aa, Chlamydia trachomatis
CNGLF

SEQ ID NO: 4755 - protein, 5 aa, Chlamydia trachomatis
NGLFT

SEQ ID NO: 4756 - protein, 5 aa, Chlamydia trachomatis
GLFTP

SEQ ID NO: 4757 - protein, 5 aa, Chlamydia trachomatis
LFTPS

SEQ ID NO: 4758 - protein, 5 aa, Chlamydia trachomatis
FTPSN

SEQ ID NO: 4759 - protein, 5 aa, Chlamydia trachomatis
TPSNI

SEQ ID NO: 4760 - protein, 5 aa, Chlamydia trachomatis
PSNIE

SEQ ID NO: 4761 - protein, 5 aa, Chlamydia trachomatis
SNIET

SEQ ID NO: 4762 - protein, 5 aa, Chlamydia trachomatis
NIETL

SEQ ID NO: 4763 - protein, 5 aa, Chlamydia trachomatis
IETLL

SEQ ID NO: 4764 - protein, 5 aa, Chlamydia trachomatis
ETLLG

SEQ ID NO: 4765 - protein, 5 aa, Chlamydia trachomatis
TLLGG

SEQ ID NO: 4766 - protein, 5 aa, Chlamydia trachomatis
LLGGT

SEQ ID NO: 4767 - protein, 5 aa, Chlamydia trachomatis
LGGTE

SEQ ID NO: 4768 - protein, 5 aa, Chlamydia trachomatis
GGTEI

SEQ ID NO: 4769 - protein, 5 aa, Chlamydia trachomatis
GTEIG

SEQ ID NO: 4770 - protein, 5 aa, Chlamydia trachomatis
TEIGK

SEQ ID NO: 4771 - protein, 5 aa, Chlamydia trachomatis
EIGKF

SEQ ID NO: 4772 - protein, 5 aa, Chlamydia trachomatis
IGKFT

SEQ ID NO: 4773 - protein, 5 aa, Chlamydia trachomatis
GKFTV

SEQ ID NO: 4774 - protein, 5 aa, Chlamydia trachomatis
KFTVT

SEQ ID NO: 4775 - protein, 5 aa, Chlamydia trachomatis
FTVTP

SEQ ID NO: 4776 - protein, 5 aa, Chlamydia trachomatis
TVTPK

SEQ ID NO: 4777 - protein, 5 aa, Chlamydia trachomatis
VTPKS

SEQ ID NO: 4778 - protein, 5 aa, Chlamydia trachomatis
TPKSS

SEQ ID NO: 4779 - protein, 5 aa, Chlamydia trachomatis
PKSSG

SEQ ID NO: 4780 - protein, 5 aa, Chlamydia trachomatis
KSSGS

SEQ ID NO: 4781 - protein, 5 aa, Chlamydia trachomatis
SSGSM

SEQ ID NO: 4782 - protein, 5 aa, Chlamydia trachomatis
SGSMF

SEQ ID NO: 4783 - protein, 5 aa, Chlamydia trachomatis
GSMFL

SEQ ID NO: 4784 - protein, 5 aa, Chlamydia trachomatis
SMFLV

SEQ ID NO: 4785 - protein, 5 aa, Chlamydia trachomatis
MFLVS

SEQ ID NO: 4786 - protein, 5 aa, Chlamydia trachomatis
FLVSA

SEQ ID NO: 4787 - protein, 5 aa, Chlamydia trachomatis
LVSAD

SEQ ID NO: 4788 - protein, 5 aa, Chlamydia trachomatis
VSADI

SEQ ID NO: 4789 - protein, 5 aa, Chlamydia trachomatis
SADII

SEQ ID NO: 4790 - protein, 5 aa, Chlamydia trachomatis
ADIIA

SEQ ID NO: 4791 - protein, 5 aa, Chlamydia trachomatis
DIIAS

SEQ ID NO: 4792 - protein, 5 aa, Chlamydia trachomatis
IIASR

SEQ ID NO: 4793 - protein, 5 aa, Chlamydia trachomatis
IASRM

SEQ ID NO: 4794 - protein, 5 aa, Chlamydia trachomatis
ASRME

SEQ ID NO: 4795 - protein, 5 aa, Chlamydia trachomatis
SRMEG

SEQ ID NO: 4796 - protein, 5 aa, Chlamydia trachomatis
RMEGG

SEQ ID NO: 4797 - protein, 5 aa, Chlamydia trachomatis
MEGGV

SEQ ID NO: 4798 - protein, 5 aa, Chlamydia trachomatis
EGGVV

SEQ ID NO: 4799 - protein, 5 aa, Chlamydia trachomatis
GGVVL

SEQ ID NO: 4800 - protein, 5 aa, Chlamydia trachomatis
GVVLA

SEQ ID NO: 4801 - protein, 5 aa, Chlamydia trachomatis
VVLAL

SEQ ID NO: 4802 - protein, 5 aa, Chlamydia trachomatis
VLALV

SEQ ID NO: 4803 - protein, 5 aa, Chlamydia trachomatis
LALVR

SEQ ID NO: 4804 - protein, 5 aa, Chlamydia trachomatis
ALVRE

SEQ ID NO: 4805 - protein, 5 aa, Chlamydia trachomatis
LVREG

SEQ ID NO: 4806 - protein, 5 aa, Chlamydia trachomatis
VREGD

SEQ ID NO: 4807 - protein, 5 aa, Chlamydia trachomatis
REGDS

SEQ ID NO: 4808 - protein, 5 aa, Chlamydia trachomatis
EGDSK

SEQ ID NO: 4809 - protein, 5 aa, Chlamydia trachomatis
GDSKP

SEQ ID NO: 4810 - protein, 5 aa, Chlamydia trachomatis
DSKPC

SEQ ID NO: 4811 - protein, 5 aa, Chlamydia trachomatis
SKPCA

SEQ ID NO: 4812 - protein, 5 aa, Chlamydia trachomatis
KPCAI

SEQ ID NO: 4813 - protein, 5 aa, Chlamydia trachomatis
PCAIS

SEQ ID NO: 4814 - protein, 5 aa, Chlamydia trachomatis
CAISY

SEQ ID NO: 4815 - protein, 5 aa, Chlamydia trachomatis
AISYG

SEQ ID NO: 4816 - protein, 5 aa, Chlamydia trachomatis
ISYGY

SEQ ID NO: 4817 - protein, 5 aa, Chlamydia trachomatis
SYGYS

SEQ ID NO: 4818 - protein, 5 aa, Chlamydia trachomatis
YGYSS

SEQ ID NO: 4819 - protein, 5 aa, Chlamydia trachomatis
GYSSG

SEQ ID NO: 4820 - protein, 5 aa, Chlamydia trachomatis
YSSGV

SEQ ID NO: 4821 - protein, 5 aa, Chlamydia trachomatis
SSGVP

SEQ ID NO: 4822 - protein, 5 aa, Chlamydia trachomatis
SGVPN

SEQ ID NO: 4823 - protein, 5 aa, Chlamydia trachomatis
GVPNL

SEQ ID NO: 4824 - protein, 5 aa, Chlamydia trachomatis
VPNLC

SEQ ID NO: 4825 - protein, 5 aa, Chlamydia trachomatis
PNLCS

SEQ ID NO: 4826 - protein, 5 aa, Chlamydia trachomatis
NLCSL

SEQ ID NO: 4827 - protein, 5 aa, Chlamydia trachomatis
LCSLR

SEQ ID NO: 4828 - protein, 5 aa, Chlamydia trachomatis
CSLRT

SEQ ID NO: 4829 - protein, 5 aa, Chlamydia trachomatis
SLRTS

SEQ ID NO: 4830 - protein, 5 aa, Chlamydia trachomatis
LRTSI

SEQ ID NO: 4831 - protein, 5 aa, Chlamydia trachomatis
RTSIT

SEQ ID NO: 4832 - protein, 5 aa, Chlamydia trachomatis
TSITN

SEQ ID NO: 4833 - protein, 5 aa, Chlamydia trachomatis
SITNT

SEQ ID NO: 4834 - protein, 5 aa, Chlamydia trachomatis
ITNTG

SEQ ID NO: 4835 - protein, 5 aa, Chlamydia trachomatis
TNTGL

SEQ ID NO: 4836 - protein, 5 aa, Chlamydia trachomatis
NTGLT

SEQ ID NO: 4837 - protein, 5 aa, Chlamydia trachomatis
TGLTP

SEQ ID NO: 4838 - protein, 5 aa, Chlamydia trachomatis
GLTPT

SEQ ID NO: 4839 - protein, 5 aa, Chlamydia trachomatis
LTPTT

SEQ ID NO: 4840 - protein, 5 aa, Chlamydia trachomatis
TPTTY

SEQ ID NO: 4841 - protein, 5 aa, Chlamydia trachomatis
PTTYS

SEQ ID NO: 4842 - protein, 5 aa, Chlamydia trachomatis
TTYSL

SEQ ID NO: 4843 - protein, 5 aa, Chlamydia trachomatis
TYSLR

SEQ ID NO: 4844 - protein, 5 aa, Chlamydia trachomatis
YSLRV

SEQ ID NO: 4845 - protein, 5 aa, Chlamydia trachomatis
SLRVG

SEQ ID NO: 4846 - protein, 5 aa, Chlamydia trachomatis
LRVGG

SEQ ID NO: 4847 - protein, 5 aa, Chlamydia trachomatis
RVGGL

SEQ ID NO: 4848 - protein, 5 aa, Chlamydia trachomatis
VGGLE

SEQ ID NO: 4849 - protein, 5 aa, Chlamydia trachomatis
GGLES

SEQ ID NO: 4850 - protein, 5 aa, Chlamydia trachomatis
GLESG

SEQ ID NO: 4851 - protein, 5 aa, Chlamydia trachomatis
LESGV

SEQ ID NO: 4852 - protein, 5 aa, Chlamydia trachomatis
ESGVV

SEQ ID NO: 4853 - protein, 5 aa, Chlamydia trachomatis
SGVVW

SEQ ID NO: 4854 - protein, 5 aa, Chlamydia trachomatis
GVVWV

SEQ ID NO: 4855 - protein, 5 aa, Chlamydia trachomatis
VVWVN

SEQ ID NO: 4856 - protein, 5 aa, Chlamydia trachomatis
VWVNA

SEQ ID NO: 4857 - protein, 5 aa, Chlamydia trachomatis
WVNAL

SEQ ID NO: 4858 - protein, 5 aa, Chlamydia trachomatis
VNALS

SEQ ID NO: 4859 - protein, 5 aa, Chlamydia trachomatis
NALSN

SEQ ID NO: 4860 - protein, 5 aa, Chlamydia trachomatis
ALSNG

SEQ ID NO: 4861 - protein, 5 aa, Chlamydia trachomatis
LSNGN

SEQ ID NO: 4862 - protein, 5 aa, Chlamydia trachomatis
SNGND

SEQ ID NO: 4863 - protein, 5 aa, Chlamydia trachomatis
NGNDI

SEQ ID NO: 4864 - protein, 5 aa, Chlamydia trachomatis
GNDIL

SEQ ID NO: 4865 - protein, 5 aa, Chlamydia trachomatis
NDILG

SEQ ID NO: 4866 - protein, 5 aa, Chlamydia trachomatis
DILGI

SEQ ID NO: 4867 - protein, 5 aa, Chlamydia trachomatis
ILGIT

SEQ ID NO: 4868 - protein, 5 aa, Chlamydia trachomatis
LGITN

SEQ ID NO: 4869 - protein, 5 aa, Chlamydia trachomatis
GITNT

SEQ ID NO: 4870 - protein, 5 aa, Chlamydia trachomatis
ITNTS

SEQ ID NO: 4871 - protein, 5 aa, Chlamydia trachomatis
TNTSN

SEQ ID NO: 4872 - protein, 5 aa, Chlamydia trachomatis
NTSNV

SEQ ID NO: 4873 - protein, 5 aa, Chlamydia trachomatis
TSNVS

SEQ ID NO: 4874 - protein, 5 aa, Chlamydia trachomatis
SNVSF

SEQ ID NO: 4875 - protein, 5 aa, Chlamydia trachomatis
NVSFL

SEQ ID NO: 4876 - protein, 5 aa, Chlamydia trachomatis
VSFLE

SEQ ID NO: 4877 - protein, 5 aa, Chlamydia trachomatis
SFLEV

SEQ ID NO: 4878 - protein, 5 aa, Chlamydia trachomatis
FLEVI

SEQ ID NO: 4879 - protein, 5 aa, Chlamydia trachomatis
LEVIP

SEQ ID NO: 4880 - protein, 5 aa, Chlamydia trachomatis
EVIPQ

SEQ ID NO: 4881 - protein, 5 aa, Chlamydia trachomatis
VIPQT

SEQ ID NO: 4882 - protein, 5 aa, Chlamydia trachomatis
IPQTN

SEQ ID NO: 4883 - protein, 5 aa, Chlamydia trachomatis
PQTNA

SEQ ID NO: 4884 - protein, 5 aa, Chlamydia trachomatis
MMKRL

SEQ ID NO: 4885 - protein, 5 aa, Chlamydia trachomatis
MKRLL

SEQ ID NO: 4886 - protein, 5 aa, Chlamydia trachomatis
KRLLC

SEQ ID NO: 4887 - protein, 5 aa, Chlamydia trachomatis
RLLCV

SEQ ID NO: 4888 - protein, 5 aa, Chlamydia trachomatis
LLCVL

SEQ ID NO: 4889 - protein, 5 aa, Chlamydia trachomatis
LCVLL

SEQ ID NO: 4890 - protein, 5 aa, Chlamydia trachomatis
CVLLS

SEQ ID NO: 4891 - protein, 5 aa, Chlamydia trachomatis
VLLST

SEQ ID NO: 4892 - protein, 5 aa, Chlamydia trachomatis
LLSTS

SEQ ID NO: 4893 - protein, 5 aa, Chlamydia trachomatis
LSTSV

SEQ ID NO: 4894 - protein, 5 aa, Chlamydia trachomatis
STSVF

SEQ ID NO: 4895 - protein, 5 aa, Chlamydia trachomatis
TSVFS

SEQ ID NO: 4896 - protein, 5 aa, Chlamydia trachomatis
SVFSS

SEQ ID NO: 4897 - protein, 5 aa, Chlamydia trachomatis
VFSSP

SEQ ID NO: 4898 - protein, 5 aa, Chlamydia trachomatis
FSSPM

SEQ ID NO: 4899 - protein, 5 aa, Chlamydia trachomatis
SSPML

SEQ ID NO: 4900 - protein, 5 aa, Chlamydia trachomatis
SPMLG

SEQ ID NO: 4901 - protein, 5 aa, Chlamydia trachomatis
PMLGY

SEQ ID NO: 4902 - protein, 5 aa, Chlamydia trachomatis
MLGYS

SEQ ID NO: 4903 - protein, 5 aa, Chlamydia trachomatis
LGYSA

SEQ ID NO: 4904 - protein, 5 aa, Chlamydia trachomatis
GYSAS

SEQ ID NO: 4905 - protein, 5 aa, Chlamydia trachomatis
YSASK

SEQ ID NO: 4906 - protein, 5 aa, Chlamydia trachomatis
SASKK

SEQ ID NO: 4907 - protein, 5 aa, Chlamydia trachomatis
ASKKD

SEQ ID NO: 4908 - protein, 5 aa, Chlamydia trachomatis
SKKDS

SEQ ID NO: 4909 - protein, 5 aa, Chlamydia trachomatis
KKDSK

SEQ ID NO: 4910 - protein, 5 aa, Chlamydia trachomatis
KDSKA

SEQ ID NO: 4911 - protein, 5 aa, Chlamydia trachomatis
DSKAD

SEQ ID NO: 4912 - protein, 5 aa, Chlamydia trachomatis
SKADI

SEQ ID NO: 4913 - protein, 5 aa, Chlamydia trachomatis
KADIC

SEQ ID NO: 4914 - protein, 5 aa, Chlamydia trachomatis
ADICL

SEQ ID NO: 4915 - protein, 5 aa, Chlamydia trachomatis
DICLA

SEQ ID NO: 4916 - protein, 5 aa, Chlamydia trachomatis
ICLAV

SEQ ID NO: 4917 - protein, 5 aa, Chlamydia trachomatis
CLAVS

SEQ ID NO: 4918 - protein, 5 aa, Chlamydia trachomatis
LAVSS

SEQ ID NO: 4919 - protein, 5 aa, Chlamydia trachomatis
AVSSG

SEQ ID NO: 4920 - protein, 5 aa, Chlamydia trachomatis
VSSGD

SEQ ID NO: 4921 - protein, 5 aa, Chlamydia trachomatis
SSGDQ

SEQ ID NO: 4922 - protein, 5 aa, Chlamydia trachomatis
SGDQE

SEQ ID NO: 4923 - protein, 5 aa, Chlamydia trachomatis
GDQEV

SEQ ID NO: 4924 - protein, 5 aa, Chlamydia trachomatis
DQEVS

SEQ ID NO: 4925 - protein, 5 aa, Chlamydia trachomatis
QEVSQ

SEQ ID NO: 4926 - protein, 5 aa, Chlamydia trachomatis
EVSQE

SEQ ID NO: 4927 - protein, 5 aa, Chlamydia trachomatis
VSQED

SEQ ID NO: 4928 - protein, 5 aa, Chlamydia trachomatis
SQEDL

SEQ ID NO: 4929 - protein, 5 aa, Chlamydia trachomatis
QEDLL

SEQ ID NO: 4930 - protein, 5 aa, Chlamydia trachomatis
EDLLK

SEQ ID NO: 4931 - protein, 5 aa, Chlamydia trachomatis
DLLKE

SEQ ID NO: 4932 - protein, 5 aa, Chlamydia trachomatis
LLKEV

SEQ ID NO: 4933 - protein, 5 aa, Chlamydia trachomatis
LKEVS

SEQ ID NO: 4934 - protein, 5 aa, Chlamydia trachomatis
KEVSR

SEQ ID NO: 4935 - protein, 5 aa, Chlamydia trachomatis
EVSRG

SEQ ID NO: 4936 - protein, 5 aa, Chlamydia trachomatis
VSRGF

SEQ ID NO: 4937 - protein, 5 aa, Chlamydia trachomatis
SRGFS

SEQ ID NO: 4938 - protein, 5 aa, Chlamydia trachomatis
RGFSR

SEQ ID NO: 4939 - protein, 5 aa, Chlamydia trachomatis
GFSRV

SEQ ID NO: 4940 - protein, 5 aa, Chlamydia trachomatis
FSRVA

SEQ ID NO: 4941 - protein, 5 aa, Chlamydia trachomatis
SRVAA

SEQ ID NO: 4942 - protein, 5 aa, Chlamydia trachomatis
RVAAK

SEQ ID NO: 4943 - protein, 5 aa, Chlamydia trachomatis
VAAKA

SEQ ID NO: 4944 - protein, 5 aa, Chlamydia trachomatis
AAKAT

SEQ ID NO: 4945 - protein, 5 aa, Chlamydia trachomatis
AKATP

SEQ ID NO: 4946 - protein, 5 aa, Chlamydia trachomatis
KATPG

SEQ ID NO: 4947 - protein, 5 aa, Chlamydia trachomatis
ATPGV

SEQ ID NO: 4948 - protein, 5 aa, Chlamydia trachomatis
TPGVV

SEQ ID NO: 4949 - protein, 5 aa, Chlamydia trachomatis
PGVVY

SEQ ID NO: 4950 - protein, 5 aa, Chlamydia trachomatis
GVVYI

SEQ ID NO: 4951 - protein, 5 aa, Chlamydia trachomatis
VVYIE

SEQ ID NO: 4952 - protein, 5 aa, Chlamydia trachomatis
VYIEN

SEQ ID NO: 4953 - protein, 5 aa, Chlamydia trachomatis
YIENF

SEQ ID NO: 4954 - protein, 5 aa, Chlamydia trachomatis
IENFP

SEQ ID NO: 4955 - protein, 5 aa, Chlamydia trachomatis
ENFPK

SEQ ID NO: 4956 - protein, 5 aa, Chlamydia trachomatis
NFPKT

SEQ ID NO: 4957 - protein, 5 aa, Chlamydia trachomatis
FPKTG

SEQ ID NO: 4958 - protein, 5 aa, Chlamydia trachomatis
PKTGN

SEQ ID NO: 4959 - protein, 5 aa, Chlamydia trachomatis
KTGNQ

SEQ ID NO: 4960 - protein, 5 aa, Chlamydia trachomatis
TGNQA

SEQ ID NO: 4961 - protein, 5 aa, Chlamydia trachomatis
GNQAI

SEQ ID NO: 4962 - protein, 5 aa, Chlamydia trachomatis
NQAIA

SEQ ID NO: 4963 - protein, 5 aa, Chlamydia trachomatis
QAIAS

SEQ ID NO: 4964 - protein, 5 aa, Chlamydia trachomatis
AIASP

SEQ ID NO: 4965 - protein, 5 aa, Chlamydia trachomatis
IASPG

SEQ ID NO: 4966 - protein, 5 aa, Chlamydia trachomatis
ASPGN

SEQ ID NO: 4967 - protein, 5 aa, Chlamydia trachomatis
SPGNK

SEQ ID NO: 4968 - protein, 5 aa, Chlamydia trachomatis
PGNKR

SEQ ID NO: 4969 - protein, 5 aa, Chlamydia trachomatis
GNKRG

SEQ ID NO: 4970 - protein, 5 aa, Chlamydia trachomatis
NKRGF

SEQ ID NO: 4971 - protein, 5 aa, Chlamydia trachomatis
KRGFQ

SEQ ID NO: 4972 - protein, 5 aa, Chlamydia trachomatis
RGFQE

SEQ ID NO: 4973 - protein, 5 aa, Chlamydia trachomatis
GFQEN

SEQ ID NO: 4974 - protein, 5 aa, Chlamydia trachomatis
FQENP

SEQ ID NO: 4975 - protein, 5 aa, Chlamydia trachomatis
QENPF

SEQ ID NO: 4976 - protein, 5 aa, Chlamydia trachomatis
ENPFD

SEQ ID NO: 4977 - protein, 5 aa, Chlamydia trachomatis
NPFDY

SEQ ID NO: 4978 - protein, 5 aa, Chlamydia trachomatis
PFDYF

SEQ ID NO: 4979 - protein, 5 aa, Chlamydia trachomatis
FDYFN

SEQ ID NO: 4980 - protein, 5 aa, Chlamydia trachomatis
DYFND

SEQ ID NO: 4981 - protein, 5 aa, Chlamydia trachomatis
YFNDE

SEQ ID NO: 4982 - protein, 5 aa, Chlamydia trachomatis
FNDEF

SEQ ID NO: 4983 - protein, 5 aa, Chlamydia trachomatis
NDEFF

SEQ ID NO: 4984 - protein, 5 aa, Chlamydia trachomatis
DEFFN

SEQ ID NO: 4985 - protein, 5 aa, Chlamydia trachomatis
EFFNR

SEQ ID NO: 4986 - protein, 5 aa, Chlamydia trachomatis
FFNRF

SEQ ID NO: 4987 - protein, 5 aa, Chlamydia trachomatis
FNRFF

SEQ ID NO: 4988 - protein, 5 aa, Chlamydia trachomatis
NRFFG

SEQ ID NO: 4989 - protein, 5 aa, Chlamydia trachomatis
RFFGL

SEQ ID NO: 4990 - protein, 5 aa, Chlamydia trachomatis
FFGLP

SEQ ID NO: 4991 - protein, 5 aa, Chlamydia trachomatis
FGLPS

SEQ ID NO: 4992 - protein, 5 aa, Chlamydia trachomatis
GLPSH

SEQ ID NO: 4993 - protein, 5 aa, Chlamydia trachomatis
LPSHR

SEQ ID NO: 4994 - protein, 5 aa, Chlamydia trachomatis
PSHRE

SEQ ID NO: 4995 - protein, 5 aa, Chlamydia trachomatis
SHREQ

SEQ ID NO: 4996 - protein, 5 aa, Chlamydia trachomatis
HREQQ

SEQ ID NO: 4997 - protein, 5 aa, Chlamydia trachomatis
REQQR

SEQ ID NO: 4998 - protein, 5 aa, Chlamydia trachomatis
EQQRP

SEQ ID NO: 4999 - protein, 5 aa, Chlamydia trachomatis
QQRPQ

SEQ ID NO: 5000 - protein, 5 aa, Chlamydia trachomatis
QRPQQ

SEQ ID NO: 5001 - protein, 5 aa, Chlamydia trachomatis
RPQQR

SEQ ID NO: 5002 - protein, 5 aa, Chlamydia trachomatis
PQQRD

SEQ ID NO: 5003 - protein, 5 aa, Chlamydia trachomatis
QQRDA

SEQ ID NO: 5004 - protein, 5 aa, Chlamydia trachomatis
QRDAV

SEQ ID NO: 5005 - protein, 5 aa, Chlamydia trachomatis
RDAVR

SEQ ID NO: 5006 - protein, 5 aa, Chlamydia trachomatis
DAVRG

SEQ ID NO: 5007 - protein, 5 aa, Chlamydia trachomatis
AVRGT

SEQ ID NO: 5008 - protein, 5 aa, Chlamydia trachomatis
VRGTG

SEQ ID NO: 5009 - protein, 5 aa, Chlamydia trachomatis
RGTGF

SEQ ID NO: 5010 - protein, 5 aa, Chlamydia trachomatis
GTGFI

SEQ ID NO: 5011 - protein, 5 aa, Chlamydia trachomatis
TGFIV

SEQ ID NO: 5012 - protein, 5 aa, Chlamydia trachomatis
GFIVS

SEQ ID NO: 5013 - protein, 5 aa, Chlamydia trachomatis
FIVSE

SEQ ID NO: 5014 - protein, 5 aa, Chlamydia trachomatis
IVSED

SEQ ID NO: 5015 - protein, 5 aa, Chlamydia trachomatis
VSEDG

SEQ ID NO: 5016 - protein, 5 aa, Chlamydia trachomatis
SEDGY

SEQ ID NO: 5017 - protein, 5 aa, Chlamydia trachomatis
EDGYV

SEQ ID NO: 5018 - protein, 5 aa, Chlamydia trachomatis
DGYVV

SEQ ID NO: 5019 - protein, 5 aa, Chlamydia trachomatis
GYVVT

SEQ ID NO: 5020 - protein, 5 aa, Chlamydia trachomatis
YVVTN

SEQ ID NO: 5021 - protein, 5 aa, Chlamydia trachomatis
VVTNH

SEQ ID NO: 5022 - protein, 5 aa, Chlamydia trachomatis
VTNHH

SEQ ID NO: 5023 - protein, 5 aa, Chlamydia trachomatis
TNHHV

SEQ ID NO: 5024 - protein, 5 aa, Chlamydia trachomatis
NHHVV

SEQ ID NO: 5025 - protein, 5 aa, Chlamydia trachomatis
HHVVE

SEQ ID NO: 5026 - protein, 5 aa, Chlamydia trachomatis
HVVED

SEQ ID NO: 5027 - protein, 5 aa, Chlamydia trachomatis
VVEDA

SEQ ID NO: 5028 - protein, 5 aa, Chlamydia trachomatis
VEDAG

SEQ ID NO: 5029 - protein, 5 aa, Chlamydia trachomatis
EDAGK

SEQ ID NO: 5030 - protein, 5 aa, Chlamydia trachomatis
DAGKI

SEQ ID NO: 5031 - protein, 5 aa, Chlamydia trachomatis
AGKIH

SEQ ID NO: 5032 - protein, 5 aa, Chlamydia trachomatis
GKIHV

SEQ ID NO: 5033 - protein, 5 aa, Chlamydia trachomatis
KIHVT

SEQ ID NO: 5034 - protein, 5 aa, Chlamydia trachomatis
IHVTL

SEQ ID NO: 5035 - protein, 5 aa, Chlamydia trachomatis
HVTLH

SEQ ID NO: 5036 - protein, 5 aa, Chlamydia trachomatis
VTLHD

SEQ ID NO: 5037 - protein, 5 aa, Chlamydia trachomatis
TLHDG

SEQ ID NO: 5038 - protein, 5 aa, Chlamydia trachomatis
LHDGQ

SEQ ID NO: 5039 - protein, 5 aa, Chlamydia trachomatis
HDGQK

SEQ ID NO: 5040 - protein, 5 aa, Chlamydia trachomatis
DGQKY

SEQ ID NO: 5041 - protein, 5 aa, Chlamydia trachomatis
GQKYT

SEQ ID NO: 5042 - protein, 5 aa, Chlamydia trachomatis
QKYTA

SEQ ID NO: 5043 - protein, 5 aa, Chlamydia trachomatis
KYTAK

SEQ ID NO: 5044 - protein, 5 aa, Chlamydia trachomatis
YTAKI

SEQ ID NO: 5045 - protein, 5 aa, Chlamydia trachomatis
TAKIV

SEQ ID NO: 5046 - protein, 5 aa, Chlamydia trachomatis
AKIVG

SEQ ID NO: 5047 - protein, 5 aa, Chlamydia trachomatis
KIVGL

SEQ ID NO: 5048 - protein, 5 aa, Chlamydia trachomatis
IVGLD

SEQ ID NO: 5049 - protein, 5 aa, Chlamydia trachomatis
VGLDP

SEQ ID NO: 5050 - protein, 5 aa, Chlamydia trachomatis
GLDPK

SEQ ID NO: 5051 - protein, 5 aa, Chlamydia trachomatis
LDPKT

SEQ ID NO: 5052 - protein, 5 aa, Chlamydia trachomatis
DPKTD

SEQ ID NO: 5053 - protein, 5 aa, Chlamydia trachomatis
PKTDL

SEQ ID NO: 5054 - protein, 5 aa, Chlamydia trachomatis
KTDLA

SEQ ID NO: 5055 - protein, 5 aa, Chlamydia trachomatis
TDLAV

SEQ ID NO: 5056 - protein, 5 aa, Chlamydia trachomatis
DLAVI

SEQ ID NO: 5057 - protein, 5 aa, Chlamydia trachomatis
LAVIK

SEQ ID NO: 5058 - protein, 5 aa, Chlamydia trachomatis
AVIKI

SEQ ID NO: 5059 - protein, 5 aa, Chlamydia trachomatis
VIKIQ

SEQ ID NO: 5060 - protein, 5 aa, Chlamydia trachomatis
IKIQA

SEQ ID NO: 5061 - protein, 5 aa, Chlamydia trachomatis
KIQAE

SEQ ID NO: 5062 - protein, 5 aa, Chlamydia trachomatis
IQAEK

SEQ ID NO: 5063 - protein, 5 aa, Chlamydia trachomatis
QAEKL

SEQ ID NO: 5064 - protein, 5 aa, Chlamydia trachomatis
AEKLP

SEQ ID NO: 5065 - protein, 5 aa, Chlamydia trachomatis
EKLPF

SEQ ID NO: 5066 - protein, 5 aa, Chlamydia trachomatis
KLPFL

SEQ ID NO: 5067 - protein, 5 aa, Chlamydia trachomatis
LPFLT

SEQ ID NO: 5068 - protein, 5 aa, Chlamydia trachomatis
PFLTF

SEQ ID NO: 5069 - protein, 5 aa, Chlamydia trachomatis
FLTFG

SEQ ID NO: 5070 - protein, 5 aa, Chlamydia trachomatis
LTFGN

SEQ ID NO: 5071 - protein, 5 aa, Chlamydia trachomatis
TFGNS

SEQ ID NO: 5072 - protein, 5 aa, Chlamydia trachomatis
FGNSD

SEQ ID NO: 5073 - protein, 5 aa, Chlamydia trachomatis
GNSDQ

SEQ ID NO: 5074 - protein, 5 aa, Chlamydia trachomatis
NSDQL

SEQ ID NO: 5075 - protein, 5 aa, Chlamydia trachomatis
SDQLQ

SEQ ID NO: 5076 - protein, 5 aa, Chlamydia trachomatis
DQLQI

SEQ ID NO: 5077 - protein, 5 aa, Chlamydia trachomatis
QLQIG

SEQ ID NO: 5078 - protein, 5 aa, Chlamydia trachomatis
LQIGD

SEQ ID NO: 5079 - protein, 5 aa, Chlamydia trachomatis
QIGDW

SEQ ID NO: 5080 - protein, 5 aa, Chlamydia trachomatis
IGDWA

SEQ ID NO: 5081 - protein, 5 aa, Chlamydia trachomatis
GDWAI

SEQ ID NO: 5082 - protein, 5 aa, Chlamydia trachomatis
DWAIA

SEQ ID NO: 5083 - protein, 5 aa, Chlamydia trachomatis
WAIAI

SEQ ID NO: 5084 - protein, 5 aa, Chlamydia trachomatis
AIAIG

SEQ ID NO: 5085 - protein, 5 aa, Chlamydia trachomatis
IAIGN

SEQ ID NO: 5086 - protein, 5 aa, Chlamydia trachomatis
AIGNP

SEQ ID NO: 5087 - protein, 5 aa, Chlamydia trachomatis
IGNPF

SEQ ID NO: 5088 - protein, 5 aa, Chlamydia trachomatis
GNPFG

SEQ ID NO: 5089 - protein, 5 aa, Chlamydia trachomatis
NPFGL

SEQ ID NO: 5090 - protein, 5 aa, Chlamydia trachomatis
PFGLQ

SEQ ID NO: 5091 - protein, 5 aa, Chlamydia trachomatis
FGLQA

SEQ ID NO: 5092 - protein, 5 aa, Chlamydia trachomatis
GLQAT

SEQ ID NO: 5093 - protein, 5 aa, Chlamydia trachomatis
LQATV

SEQ ID NO: 5094 - protein, 5 aa, Chlamydia trachomatis
QATVT

SEQ ID NO: 5095 - protein, 5 aa, Chlamydia trachomatis
ATVTV

SEQ ID NO: 5096 - protein, 5 aa, Chlamydia trachomatis
TVTVG

SEQ ID NO: 5097 - protein, 5 aa, Chlamydia trachomatis
VTVGV

SEQ ID NO: 5098 - protein, 5 aa, Chlamydia trachomatis
TVGVI

SEQ ID NO: 5099 - protein, 5 aa, Chlamydia trachomatis
VGVIS

SEQ ID NO: 5100 - protein, 5 aa, Chlamydia trachomatis
GVISA

SEQ ID NO: 5101 - protein, 5 aa, Chlamydia trachomatis
VISAK

SEQ ID NO: 5102 - protein, 5 aa, Chlamydia trachomatis
ISAKG

SEQ ID NO: 5103 - protein, 5 aa, Chlamydia trachomatis
SAKGR

SEQ ID NO: 5104 - protein, 5 aa, Chlamydia trachomatis
AKGRN

SEQ ID NO: 5105 - protein, 5 aa, Chlamydia trachomatis
KGRNQ

SEQ ID NO: 5106 - protein, 5 aa, Chlamydia trachomatis
GRNQL

SEQ ID NO: 5107 - protein, 5 aa, Chlamydia trachomatis
RNQLH

SEQ ID NO: 5108 - protein, 5 aa, Chlamydia trachomatis
NQLHI

SEQ ID NO: 5109 - protein, 5 aa, Chlamydia trachomatis
QLHIV

SEQ ID NO: 5110 - protein, 5 aa, Chlamydia trachomatis
LHIVD

SEQ ID NO: 5111 - protein, 5 aa, Chlamydia trachomatis
HIVDF

SEQ ID NO: 5112 - protein, 5 aa, Chlamydia trachomatis
IVDFE

SEQ ID NO: 5113 - protein, 5 aa, Chlamydia trachomatis
VDFED

SEQ ID NO: 5114 - protein, 5 aa, Chlamydia trachomatis
DFEDF

SEQ ID NO: 5115 - protein, 5 aa, Chlamydia trachomatis
FEDFI

SEQ ID NO: 5116 - protein, 5 aa, Chlamydia trachomatis
EDFIQ

SEQ ID NO: 5117 - protein, 5 aa, Chlamydia trachomatis
DFIQT

SEQ ID NO: 5118 - protein, 5 aa, Chlamydia trachomatis
FIQTD

SEQ ID NO: 5119 - protein, 5 aa, Chlamydia trachomatis
IQTDA

SEQ ID NO: 5120 - protein, 5 aa, Chlamydia trachomatis
QTDAA

SEQ ID NO: 5121 - protein, 5 aa, Chlamydia trachomatis
TDAAI

SEQ ID NO: 5122 - protein, 5 aa, Chlamydia trachomatis
DAAIN

SEQ ID NO: 5123 - protein, 5 aa, Chlamydia trachomatis
AAINP

SEQ ID NO: 5124 - protein, 5 aa, Chlamydia trachomatis
AINPG

SEQ ID NO: 5125 - protein, 5 aa, Chlamydia trachomatis
INPGN

SEQ ID NO: 5126 - protein, 5 aa, Chlamydia trachomatis
NPGNS

SEQ ID NO: 5127 - protein, 5 aa, Chlamydia trachomatis
PGNSG

SEQ ID NO: 5128 - protein, 5 aa, Chlamydia trachomatis
GNSGG

SEQ ID NO: 5129 - protein, 5 aa, Chlamydia trachomatis
NSGGP

SEQ ID NO: 5130 - protein, 5 aa, Chlamydia trachomatis
SGGPL

SEQ ID NO: 5131 - protein, 5 aa, Chlamydia trachomatis
GGPLL

SEQ ID NO: 5132 - protein, 5 aa, Chlamydia trachomatis
GPLLN

SEQ ID NO: 5133 - protein, 5 aa, Chlamydia trachomatis
PLLNI

SEQ ID NO: 5134 - protein, 5 aa, Chlamydia trachomatis
LLNIN

SEQ ID NO: 5135 - protein, 5 aa, Chlamydia trachomatis
LNING

SEQ ID NO: 5136 - protein, 5 aa, Chlamydia trachomatis
NINGQ

SEQ ID NO: 5137 - protein, 5 aa, Chlamydia trachomatis
INGQV

SEQ ID NO: 5138 - protein, 5 aa, Chlamydia trachomatis
NGQVI

SEQ ID NO: 5139 - protein, 5 aa, Chlamydia trachomatis
GQVIG

SEQ ID NO: 5140 - protein, 5 aa, Chlamydia trachomatis
QVIGV

SEQ ID NO: 5141 - protein, 5 aa, Chlamydia trachomatis
VIGVN

SEQ ID NO: 5142 - protein, 5 aa, Chlamydia trachomatis
IGVNT

SEQ ID NO: 5143 - protein, 5 aa, Chlamydia trachomatis
GVNTA

SEQ ID NO: 5144 - protein, 5 aa, Chlamydia trachomatis
VNTAI

SEQ ID NO: 5145 - protein, 5 aa, Chlamydia trachomatis
NTAIV

SEQ ID NO: 5146 - protein, 5 aa, Chlamydia trachomatis
TAIVS

SEQ ID NO: 5147 - protein, 5 aa, Chlamydia trachomatis
AIVSG

SEQ ID NO: 5148 - protein, 5 aa, Chlamydia trachomatis
IVSGS

SEQ ID NO: 5149 - protein, 5 aa, Chlamydia trachomatis
VSGSG

SEQ ID NO: 5150 - protein, 5 aa, Chlamydia trachomatis
SGSGG

SEQ ID NO: 5151 - protein, 5 aa, Chlamydia trachomatis
GSGGY

SEQ ID NO: 5152 - protein, 5 aa, Chlamydia trachomatis
SGGYI

SEQ ID NO: 5153 - protein, 5 aa, Chlamydia trachomatis
GGYIG

SEQ ID NO: 5154 - protein, 5 aa, Chlamydia trachomatis
GYIGI

SEQ ID NO: 5155 - protein, 5 aa, Chlamydia trachomatis
YIGIG

SEQ ID NO: 5156 - protein, 5 aa, Chlamydia trachomatis
IGIGF

SEQ ID NO: 5157 - protein, 5 aa, Chlamydia trachomatis
GIGFA

SEQ ID NO: 5158 - protein, 5 aa, Chlamydia trachomatis
IGFAI

SEQ ID NO: 5159 - protein, 5 aa, Chlamydia trachomatis
GFAIP

SEQ ID NO: 5160 - protein, 5 aa, Chlamydia trachomatis
FAIPS

SEQ ID NO: 5161 - protein, 5 aa, Chlamydia trachomatis
AIPSL

SEQ ID NO: 5162 - protein, 5 aa, Chlamydia trachomatis
IPSLM

SEQ ID NO: 5163 - protein, 5 aa, Chlamydia trachomatis
PSLMA

SEQ ID NO: 5164 - protein, 5 aa, Chlamydia trachomatis
SLMAK

SEQ ID NO: 5165 - protein, 5 aa, Chlamydia trachomatis
LMAKR

SEQ ID NO: 5166 - protein, 5 aa, Chlamydia trachomatis
MAKRV

SEQ ID NO: 5167 - protein, 5 aa, Chlamydia trachomatis
AKRVI

SEQ ID NO: 5168 - protein, 5 aa, Chlamydia trachomatis
KRVID

SEQ ID NO: 5169 - protein, 5 aa, Chlamydia trachomatis
RVIDQ

SEQ ID NO: 5170 - protein, 5 aa, Chlamydia trachomatis
VIDQL

SEQ ID NO: 5171 - protein, 5 aa, Chlamydia trachomatis
IDQLI

SEQ ID NO: 5172 - protein, 5 aa, Chlamydia trachomatis
DQLIS

SEQ ID NO: 5173 - protein, 5 aa, Chlamydia trachomatis
QLISD

SEQ ID NO: 5174 - protein, 5 aa, Chlamydia trachomatis
LISDG

SEQ ID NO: 5175 - protein, 5 aa, Chlamydia trachomatis
ISDGQ

SEQ ID NO: 5176 - protein, 5 aa, Chlamydia trachomatis
SDGQV

SEQ ID NO: 5177 - protein, 5 aa, Chlamydia trachomatis
DGQVT

SEQ ID NO: 5178 - protein, 5 aa, Chlamydia trachomatis
GQVTR

SEQ ID NO: 5179 - protein, 5 aa, Chlamydia trachomatis
QVTRG

SEQ ID NO: 5180 - protein, 5 aa, Chlamydia trachomatis
VTRGF

SEQ ID NO: 5181 - protein, 5 aa, Chlamydia trachomatis
TRGFL

SEQ ID NO: 5182 - protein, 5 aa, Chlamydia trachomatis
RGFLG

SEQ ID NO: 5183 - protein, 5 aa, Chlamydia trachomatis
GFLGV

SEQ ID NO: 5184 - protein, 5 aa, Chlamydia trachomatis
FLGVT

SEQ ID NO: 5185 - protein, 5 aa, Chlamydia trachomatis
LGVTL

SEQ ID NO: 5186 - protein, 5 aa, Chlamydia trachomatis
GVTLQ

SEQ ID NO: 5187 - protein, 5 aa, Chlamydia trachomatis
VTLQP

SEQ ID NO: 5188 - protein, 5 aa, Chlamydia trachomatis
TLQPI

SEQ ID NO: 5189 - protein, 5 aa, Chlamydia trachomatis
LQPID

SEQ ID NO: 5190 - protein, 5 aa, Chlamydia trachomatis
QPIDS

SEQ ID NO: 5191 - protein, 5 aa, Chlamydia trachomatis
PIDSE

SEQ ID NO: 5192 - protein, 5 aa, Chlamydia trachomatis
IDSEL

SEQ ID NO: 5193 - protein, 5 aa, Chlamydia trachomatis
DSELA

SEQ ID NO: 5194 - protein, 5 aa, Chlamydia trachomatis
SELAT

SEQ ID NO: 5195 - protein, 5 aa, Chlamydia trachomatis
ELATC

SEQ ID NO: 5196 - protein, 5 aa, Chlamydia trachomatis
LATCY

SEQ ID NO: 5197 - protein, 5 aa, Chlamydia trachomatis
ATCYK

SEQ ID NO: 5198 - protein, 5 aa, Chlamydia trachomatis
TCYKL

SEQ ID NO: 5199 - protein, 5 aa, Chlamydia trachomatis
CYKLE

SEQ ID NO: 5200 - protein, 5 aa, Chlamydia trachomatis
YKLEK

SEQ ID NO: 5201 - protein, 5 aa, Chlamydia trachomatis
KLEKV

SEQ ID NO: 5202 - protein, 5 aa, Chlamydia trachomatis
LEKVY

SEQ ID NO: 5203 - protein, 5 aa, Chlamydia trachomatis
EKVYG

SEQ ID NO: 5204 - protein, 5 aa, Chlamydia trachomatis
KVYGA

SEQ ID NO: 5205 - protein, 5 aa, Chlamydia trachomatis
VYGAL

SEQ ID NO: 5206 - protein, 5 aa, Chlamydia trachomatis
YGALV

SEQ ID NO: 5207 - protein, 5 aa, Chlamydia trachomatis
GALVT

SEQ ID NO: 5208 - protein, 5 aa, Chlamydia trachomatis
ALVTD

SEQ ID NO: 5209 - protein, 5 aa, Chlamydia trachomatis
LVTDV

SEQ ID NO: 5210 - protein, 5 aa, Chlamydia trachomatis
VTDVV

SEQ ID NO: 5211 - protein, 5 aa, Chlamydia trachomatis
TDVVK

SEQ ID NO: 5212 - protein, 5 aa, Chlamydia trachomatis
DVVKG

SEQ ID NO: 5213 - protein, 5 aa, Chlamydia trachomatis
VVKGS

SEQ ID NO: 5214 - protein, 5 aa, Chlamydia trachomatis
VKGSP

SEQ ID NO: 5215 - protein, 5 aa, Chlamydia trachomatis
KGSPA

SEQ ID NO: 5216 - protein, 5 aa, Chlamydia trachomatis
GSPAE

SEQ ID NO: 5217 - protein, 5 aa, Chlamydia trachomatis
SPAEK

SEQ ID NO: 5218 - protein, 5 aa, Chlamydia trachomatis
PAEKA

SEQ ID NO: 5219 - protein, 5 aa, Chlamydia trachomatis
AEKAG

SEQ ID NO: 5220 - protein, 5 aa, Chlamydia trachomatis
EKAGL

SEQ ID NO: 5221 - protein, 5 aa, Chlamydia trachomatis
KAGLR

SEQ ID NO: 5222 - protein, 5 aa, Chlamydia trachomatis
AGLRQ

SEQ ID NO: 5223 - protein, 5 aa, Chlamydia trachomatis
GLRQE

SEQ ID NO: 5224 - protein, 5 aa, Chlamydia trachomatis
LRQED

SEQ ID NO: 5225 - protein, 5 aa, Chlamydia trachomatis
RQEDV

SEQ ID NO: 5226 - protein, 5 aa, Chlamydia trachomatis
QEDVI

SEQ ID NO: 5227 - protein, 5 aa, Chlamydia trachomatis
EDVIV

SEQ ID NO: 5228 - protein, 5 aa, Chlamydia trachomatis
DVIVA

SEQ ID NO: 5229 - protein, 5 aa, Chlamydia trachomatis
VIVAY

SEQ ID NO: 5230 - protein, 5 aa, Chlamydia trachomatis
IVAYN

SEQ ID NO: 5231 - protein, 5 aa, Chlamydia trachomatis
VAYNG

SEQ ID NO: 5232 - protein, 5 aa, Chlamydia trachomatis
AYNGK

SEQ ID NO: 5233 - protein, 5 aa, Chlamydia trachomatis
YNGKE

SEQ ID NO: 5234 - protein, 5 aa, Chlamydia trachomatis
NGKEV

SEQ ID NO: 5235 - protein, 5 aa, Chlamydia trachomatis
GKEVE

SEQ ID NO: 5236 - protein, 5 aa, Chlamydia trachomatis
KEVES

SEQ ID NO: 5237 - protein, 5 aa, Chlamydia trachomatis
EVESL

SEQ ID NO: 5238 - protein, 5 aa, Chlamydia trachomatis
VESLS

SEQ ID NO: 5239 - protein, 5 aa, Chlamydia trachomatis
ESLSA

SEQ ID NO: 5240 - protein, 5 aa, Chlamydia trachomatis
SLSAL

SEQ ID NO: 5241 - protein, 5 aa, Chlamydia trachomatis
LSALR

SEQ ID NO: 5242 - protein, 5 aa, Chlamydia trachomatis
SALRN

SEQ ID NO: 5243 - protein, 5 aa, Chlamydia trachomatis
ALRNA

SEQ ID NO: 5244 - protein, 5 aa, Chlamydia trachomatis
LRNAI

SEQ ID NO: 5245 - protein, 5 aa, Chlamydia trachomatis
RNAIS

SEQ ID NO: 5246 - protein, 5 aa, Chlamydia trachomatis
NAISL

SEQ ID NO: 5247 - protein, 5 aa, Chlamydia trachomatis
AISLM

SEQ ID NO: 5248 - protein, 5 aa, Chlamydia trachomatis
ISLMM

SEQ ID NO: 5249 - protein, 5 aa, Chlamydia trachomatis
SLMMP

SEQ ID NO: 5250 - protein, 5 aa, Chlamydia trachomatis
LMMPG

SEQ ID NO: 5251 - protein, 5 aa, Chlamydia trachomatis
MMPGT

SEQ ID NO: 5252 - protein, 5 aa, Chlamydia trachomatis
MPGTR

SEQ ID NO: 5253 - protein, 5 aa, Chlamydia trachomatis
PGTRV

SEQ ID NO: 5254 - protein, 5 aa, Chlamydia trachomatis
GTRVV

SEQ ID NO: 5255 - protein, 5 aa, Chlamydia trachomatis
TRVVL

SEQ ID NO: 5256 - protein, 5 aa, Chlamydia trachomatis
RVVLK

SEQ ID NO: 5257 - protein, 5 aa, Chlamydia trachomatis
VVLKI

SEQ ID NO: 5258 - protein, 5 aa, Chlamydia trachomatis
VLKIV

SEQ ID NO: 5259 - protein, 5 aa, Chlamydia trachomatis
LKIVR

SEQ ID NO: 5260 - protein, 5 aa, Chlamydia trachomatis
KIVRE

SEQ ID NO: 5261 - protein, 5 aa, Chlamydia trachomatis
IVREG

SEQ ID NO: 5262 - protein, 5 aa, Chlamydia trachomatis
VREGK

SEQ ID NO: 5263 - protein, 5 aa, Chlamydia trachomatis
REGKT

SEQ ID NO: 5264 - protein, 5 aa, Chlamydia trachomatis
EGKTI

SEQ ID NO: 5265 - protein, 5 aa, Chlamydia trachomatis
GKTIE

SEQ ID NO: 5266 - protein, 5 aa, Chlamydia trachomatis
KTIEI

SEQ ID NO: 5267 - protein, 5 aa, Chlamydia trachomatis
TIEIP

SEQ ID NO: 5268 - protein, 5 aa, Chlamydia trachomatis
IEIPV

SEQ ID NO: 5269 - protein, 5 aa, Chlamydia trachomatis
EIPVT

SEQ ID NO: 5270 - protein, 5 aa, Chlamydia trachomatis
IPVTV

SEQ ID NO: 5271 - protein, 5 aa, Chlamydia trachomatis
PVTVT

SEQ ID NO: 5272 - protein, 5 aa, Chlamydia trachomatis
VTVTQ

SEQ ID NO: 5273 - protein, 5 aa, Chlamydia trachomatis
TVTQI

SEQ ID NO: 5274 - protein, 5 aa, Chlamydia trachomatis
VTQIP

SEQ ID NO: 5275 - protein, 5 aa, Chlamydia trachomatis
TQIPT

SEQ ID NO: 5276 - protein, 5 aa, Chlamydia trachomatis
QIPTE

SEQ ID NO: 5277 - protein, 5 aa, Chlamydia trachomatis
IPTED

SEQ ID NO: 5278 - protein, 5 aa, Chlamydia trachomatis
PTEDG

SEQ ID NO: 5279 - protein, 5 aa, Chlamydia trachomatis
TEDGV

SEQ ID NO: 5280 - protein, 5 aa, Chlamydia trachomatis
EDGVS

SEQ ID NO: 5281 - protein, 5 aa, Chlamydia trachomatis
DGVSA

SEQ ID NO: 5282 - protein, 5 aa, Chlamydia trachomatis
GVSAL

SEQ ID NO: 5283 - protein, 5 aa, Chlamydia trachomatis
VSALQ

SEQ ID NO: 5284 - protein, 5 aa, Chlamydia trachomatis
SALQK

SEQ ID NO: 5285 - protein, 5 aa, Chlamydia trachomatis
ALQKM

SEQ ID NO: 5286 - protein, 5 aa, Chlamydia trachomatis
LQKMG

SEQ ID NO: 5287 - protein, 5 aa, Chlamydia trachomatis
QKMGV

SEQ ID NO: 5288 - protein, 5 aa, Chlamydia trachomatis
KMGVR

SEQ ID NO: 5289 - protein, 5 aa, Chlamydia trachomatis
MGVRV

SEQ ID NO: 5290 - protein, 5 aa, Chlamydia trachomatis
GVRVQ

SEQ ID NO: 5291 - protein, 5 aa, Chlamydia trachomatis
VRVQN

SEQ ID NO: 5292 - protein, 5 aa, Chlamydia trachomatis
RVQNI

SEQ ID NO: 5293 - protein, 5 aa, Chlamydia trachomatis
VQNIT

SEQ ID NO: 5294 - protein, 5 aa, Chlamydia trachomatis
QNITP

SEQ ID NO: 5295 - protein, 5 aa, Chlamydia trachomatis
NITPE

SEQ ID NO: 5296 - protein, 5 aa, Chlamydia trachomatis
ITPEI

SEQ ID NO: 5297 - protein, 5 aa, Chlamydia trachomatis
TPEIC

SEQ ID NO: 5298 - protein, 5 aa, Chlamydia trachomatis
PEICK

SEQ ID NO: 5299 - protein, 5 aa, Chlamydia trachomatis
EICKK

SEQ ID NO: 5300 - protein, 5 aa, Chlamydia trachomatis
ICKKL

SEQ ID NO: 5301 - protein, 5 aa, Chlamydia trachomatis
CKKLG

SEQ ID NO: 5302 - protein, 5 aa, Chlamydia trachomatis
KKLGL

SEQ ID NO: 5303 - protein, 5 aa, Chlamydia trachomatis
KLGLA

SEQ ID NO: 5304 - protein, 5 aa, Chlamydia trachomatis
LGLAA

SEQ ID NO: 5305 - protein, 5 aa, Chlamydia trachomatis
GLAAD

SEQ ID NO: 5306 - protein, 5 aa, Chlamydia trachomatis
LAADT

SEQ ID NO: 5307 - protein, 5 aa, Chlamydia trachomatis
AADTR

SEQ ID NO: 5308 - protein, 5 aa, Chlamydia trachomatis
ADTRG

SEQ ID NO: 5309 - protein, 5 aa, Chlamydia trachomatis
DTRGI

SEQ ID NO: 5310 - protein, 5 aa, Chlamydia trachomatis
TRGIL

SEQ ID NO: 5311 - protein, 5 aa, Chlamydia trachomatis
RGILV

SEQ ID NO: 5312 - protein, 5 aa, Chlamydia trachomatis
GILVV

SEQ ID NO: 5313 - protein, 5 aa, Chlamydia trachomatis
ILVVA

SEQ ID NO: 5314 - protein, 5 aa, Chlamydia trachomatis
LVVAV

SEQ ID NO: 5315 - protein, 5 aa, Chlamydia trachomatis
VVAVE

SEQ ID NO: 5316 - protein, 5 aa, Chlamydia trachomatis
VAVEA

SEQ ID NO: 5317 - protein, 5 aa, Chlamydia trachomatis
AVEAG

SEQ ID NO: 5318 - protein, 5 aa, Chlamydia trachomatis
VEAGS

SEQ ID NO: 5319 - protein, 5 aa, Chlamydia trachomatis
EAGSP

SEQ ID NO: 5320 - protein, 5 aa, Chlamydia trachomatis
AGSPA

SEQ ID NO: 5321 - protein, 5 aa, Chlamydia trachomatis
GSPAA

SEQ ID NO: 5322 - protein, 5 aa, Chlamydia trachomatis
SPAAS

SEQ ID NO: 5323 - protein, 5 aa, Chlamydia trachomatis
PAASA

SEQ ID NO: 5324 - protein, 5 aa, Chlamydia trachomatis
AASAG

SEQ ID NO: 5325 - protein, 5 aa, Chlamydia trachomatis
ASAGV

SEQ ID NO: 5326 - protein, 5 aa, Chlamydia trachomatis
SAGVA

SEQ ID NO: 5327 - protein, 5 aa, Chlamydia trachomatis
AGVAP

SEQ ID NO: 5328 - protein, 5 aa, Chlamydia trachomatis
GVAPG

SEQ ID NO: 5329 - protein, 5 aa, Chlamydia trachomatis
VAPGQ

SEQ ID NO: 5330 - protein, 5 aa, Chlamydia trachomatis
APGQL

SEQ ID NO: 5331 - protein, 5 aa, Chlamydia trachomatis
PGQLI

SEQ ID NO: 5332 - protein, 5 aa, Chlamydia trachomatis
GQLIL

SEQ ID NO: 5333 - protein, 5 aa, Chlamydia trachomatis
QLILA

SEQ ID NO: 5334 - protein, 5 aa, Chlamydia trachomatis
LILAV

SEQ ID NO: 5335 - protein, 5 aa, Chlamydia trachomatis
ILAVN

SEQ ID NO: 5336 - protein, 5 aa, Chlamydia trachomatis
LAVNR

SEQ ID NO: 5337 - protein, 5 aa, Chlamydia trachomatis
AVNRQ

SEQ ID NO: 5338 - protein, 5 aa, Chlamydia trachomatis
VNRQR

SEQ ID NO: 5339 - protein, 5 aa, Chlamydia trachomatis
NRQRV

SEQ ID NO: 5340 - protein, 5 aa, Chlamydia trachomatis
RQRVA

SEQ ID NO: 5341 - protein, 5 aa, Chlamydia trachomatis
QRVAS

SEQ ID NO: 5342 - protein, 5 aa, Chlamydia trachomatis
RVASV

SEQ ID NO: 5343 - protein, 5 aa, Chlamydia trachomatis
VASVE

SEQ ID NO: 5344 - protein, 5 aa, Chlamydia trachomatis
ASVEE

SEQ ID NO: 5345 - protein, 5 aa, Chlamydia trachomatis
SVEEL

SEQ ID NO: 5346 - protein, 5 aa, Chlamydia trachomatis
VEELN

SEQ ID NO: 5347 - protein, 5 aa, Chlamydia trachomatis
EELNQ

SEQ ID NO: 5348 - protein, 5 aa, Chlamydia trachomatis
ELNQV

SEQ ID NO: 5349 - protein, 5 aa, Chlamydia trachomatis
LNQVL

SEQ ID NO: 5350 - protein, 5 aa, Chlamydia trachomatis
NQVLK

SEQ ID NO: 5351 - protein, 5 aa, Chlamydia trachomatis
QVLKN

SEQ ID NO: 5352 - protein, 5 aa, Chlamydia trachomatis
VLKNS

SEQ ID NO: 5353 - protein, 5 aa, Chlamydia trachomatis
LKNSK

SEQ ID NO: 5354 - protein, 5 aa, Chlamydia trachomatis
KNSKG

SEQ ID NO: 5355 - protein, 5 aa, Chlamydia trachomatis
NSKGE

SEQ ID NO: 5356 - protein, 5 aa, Chlamydia trachomatis
SKGEN

SEQ ID NO: 5357 - protein, 5 aa, Chlamydia trachomatis
KGENV

SEQ ID NO: 5358 - protein, 5 aa, Chlamydia trachomatis
GENVL

SEQ ID NO: 5359 - protein, 5 aa, Chlamydia trachomatis
ENVLL

SEQ ID NO: 5360 - protein, 5 aa, Chlamydia trachomatis
NVLLM

SEQ ID NO: 5361 - protein, 5 aa, Chlamydia trachomatis
VLLMV

SEQ ID NO: 5362 - protein, 5 aa, Chlamydia trachomatis
LLMVS

SEQ ID NO: 5363 - protein, 5 aa, Chlamydia trachomatis
LMVSQ

SEQ ID NO: 5364 - protein, 5 aa, Chlamydia trachomatis
MVSQG

SEQ ID NO: 5365 - protein, 5 aa, Chlamydia trachomatis
VSQGD

SEQ ID NO: 5366 - protein, 5 aa, Chlamydia trachomatis
SQGDV

SEQ ID NO: 5367 - protein, 5 aa, Chlamydia trachomatis
QGDVV

SEQ ID NO: 5368 - protein, 5 aa, Chlamydia trachomatis
GDVVR

SEQ ID NO: 5369 - protein, 5 aa, Chlamydia trachomatis
DVVRF

SEQ ID NO: 5370 - protein, 5 aa, Chlamydia trachomatis
VVRFI

SEQ ID NO: 5371 - protein, 5 aa, Chlamydia trachomatis
VRFIV

SEQ ID NO: 5372 - protein, 5 aa, Chlamydia trachomatis
RFIVL

SEQ ID NO: 5373 - protein, 5 aa, Chlamydia trachomatis
FIVLK

SEQ ID NO: 5374 - protein, 5 aa, Chlamydia trachomatis
IVLKS

SEQ ID NO: 5375 - protein, 5 aa, Chlamydia trachomatis
VLKSD

SEQ ID NO: 5376 - protein, 5 aa, Chlamydia trachomatis
LKSDE

SEQ ID NO: 5377 - protein, 5 aa, Chlamydia trachomatis
MKKLL

SEQ ID NO: 5378 - protein, 5 aa, Chlamydia trachomatis
KKLLK

SEQ ID NO: 5379 - protein, 5 aa, Chlamydia trachomatis
KLLKS

SEQ ID NO: 5380 - protein, 5 aa, Chlamydia trachomatis
LLKSV

SEQ ID NO: 5381 - protein, 5 aa, Chlamydia trachomatis
LKSVL

SEQ ID NO: 5382 - protein, 5 aa, Chlamydia trachomatis
KSVLV

SEQ ID NO: 5383 - protein, 5 aa, Chlamydia trachomatis
SVLVF

SEQ ID NO: 5384 - protein, 5 aa, Chlamydia trachomatis
VLVFA

SEQ ID NO: 5385 - protein, 5 aa, Chlamydia trachomatis
LVFAA

SEQ ID NO: 5386 - protein, 5 aa, Chlamydia trachomatis
VFAAL

SEQ ID NO: 5387 - protein, 5 aa, Chlamydia trachomatis
FAALS

SEQ ID NO: 5388 - protein, 5 aa, Chlamydia trachomatis
AALSS

SEQ ID NO: 5389 - protein, 5 aa, Chlamydia trachomatis
ALSSA

SEQ ID NO: 5390 - protein, 5 aa, Chlamydia trachomatis
LSSAS

SEQ ID NO: 5391 - protein, 5 aa, Chlamydia trachomatis
SSASS

SEQ ID NO: 5392 - protein, 5 aa, Chlamydia trachomatis
SASSL

SEQ ID NO: 5393 - protein, 5 aa, Chlamydia trachomatis
ASSLQ

SEQ ID NO: 5394 - protein, 5 aa, Chlamydia trachomatis
SSLQA

SEQ ID NO: 5395 - protein, 5 aa, Chlamydia trachomatis
SLQAL

SEQ ID NO: 5396 - protein, 5 aa, Chlamydia trachomatis
LQALP

SEQ ID NO: 5397 - protein, 5 aa, Chlamydia trachomatis
QALPV

SEQ ID NO: 5398 - protein, 5 aa, Chlamydia trachomatis
ALPVG

SEQ ID NO: 5399 - protein, 5 aa, Chlamydia trachomatis
LPVGN

SEQ ID NO: 5400 - protein, 5 aa, Chlamydia trachomatis
PVGNP

SEQ ID NO: 5401 - protein, 5 aa, Chlamydia trachomatis
VGNPA

SEQ ID NO: 5402 - protein, 5 aa, Chlamydia trachomatis
GNPAE

SEQ ID NO: 5403 - protein, 5 aa, Chlamydia trachomatis
NPAEP

SEQ ID NO: 5404 - protein, 5 aa, Chlamydia trachomatis
PAEPS

SEQ ID NO: 5405 - protein, 5 aa, Chlamydia trachomatis
AEPSL

SEQ ID NO: 5406 - protein, 5 aa, Chlamydia trachomatis
EPSLM

SEQ ID NO: 5407 - protein, 5 aa, Chlamydia trachomatis
PSLMI

SEQ ID NO: 5408 - protein, 5 aa, Chlamydia trachomatis
SLMID

SEQ ID NO: 5409 - protein, 5 aa, Chlamydia trachomatis
LMIDG

SEQ ID NO: 5410 - protein, 5 aa, Chlamydia trachomatis
MIDGI

SEQ ID NO: 5411 - protein, 5 aa, Chlamydia trachomatis
IDGIL

SEQ ID NO: 5412 - protein, 5 aa, Chlamydia trachomatis
DGILW

SEQ ID NO: 5413 - protein, 5 aa, Chlamydia trachomatis
GILWE

SEQ ID NO: 5414 - protein, 5 aa, Chlamydia trachomatis
ILWEG

SEQ ID NO: 5415 - protein, 5 aa, Chlamydia trachomatis
LWEGF

SEQ ID NO: 5416 - protein, 5 aa, Chlamydia trachomatis
WEGFG

SEQ ID NO: 5417 - protein, 5 aa, Chlamydia trachomatis
EGFGG

SEQ ID NO: 5418 - protein, 5 aa, Chlamydia trachomatis
GFGGD

SEQ ID NO: 5419 - protein, 5 aa, Chlamydia trachomatis
FGGDP

SEQ ID NO: 5420 - protein, 5 aa, Chlamydia trachomatis
GGDPC

SEQ ID NO: 5421 - protein, 5 aa, Chlamydia trachomatis
GDPCD

SEQ ID NO: 5422 - protein, 5 aa, Chlamydia trachomatis
DPCDP

SEQ ID NO: 5423 - protein, 5 aa, Chlamydia trachomatis
PCDPC

SEQ ID NO: 5424 - protein, 5 aa, Chlamydia trachomatis
CDPCA

SEQ ID NO: 5425 - protein, 5 aa, Chlamydia trachomatis
DPCAT

SEQ ID NO: 5426 - protein, 5 aa, Chlamydia trachomatis
PCATW

SEQ ID NO: 5427 - protein, 5 aa, Chlamydia trachomatis
CATWC

SEQ ID NO: 5428 - protein, 5 aa, Chlamydia trachomatis
ATWCD

SEQ ID NO: 5429 - protein, 5 aa, Chlamydia trachomatis
TWCDA

SEQ ID NO: 5430 - protein, 5 aa, Chlamydia trachomatis
WCDAI

SEQ ID NO: 5431 - protein, 5 aa, Chlamydia trachomatis
CDAIS

SEQ ID NO: 5432 - protein, 5 aa, Chlamydia trachomatis
DAISM

SEQ ID NO: 5433 - protein, 5 aa, Chlamydia trachomatis
AISMR

SEQ ID NO: 5434 - protein, 5 aa, Chlamydia trachomatis
ISMRV

SEQ ID NO: 5435 - protein, 5 aa, Chlamydia trachomatis
SMRVG

SEQ ID NO: 5436 - protein, 5 aa, Chlamydia trachomatis
MRVGY

SEQ ID NO: 5437 - protein, 5 aa, Chlamydia trachomatis
RVGYY

SEQ ID NO: 5438 - protein, 5 aa, Chlamydia trachomatis
VGYYG

SEQ ID NO: 5439 - protein, 5 aa, Chlamydia trachomatis
GYYGD

SEQ ID NO: 5440 - protein, 5 aa, Chlamydia trachomatis
YYGDF

SEQ ID NO: 5441 - protein, 5 aa, Chlamydia trachomatis
YGDFV

SEQ ID NO: 5442 - protein, 5 aa, Chlamydia trachomatis
GDFVF

SEQ ID NO: 5443 - protein, 5 aa, Chlamydia trachomatis
DFVFD

SEQ ID NO: 5444 - protein, 5 aa, Chlamydia trachomatis
FVFDR

SEQ ID NO: 5445 - protein, 5 aa, Chlamydia trachomatis
VFDRV

SEQ ID NO: 5446 - protein, 5 aa, Chlamydia trachomatis
FDRVL

SEQ ID NO: 5447 - protein, 5 aa, Chlamydia trachomatis
DRVLK

SEQ ID NO: 5448 - protein, 5 aa, Chlamydia trachomatis
RVLKT

SEQ ID NO: 5449 - protein, 5 aa, Chlamydia trachomatis
VLKTD

SEQ ID NO: 5450 - protein, 5 aa, Chlamydia trachomatis
LKTDV

SEQ ID NO: 5451 - protein, 5 aa, Chlamydia trachomatis
KTDVN

SEQ ID NO: 5452 - protein, 5 aa, Chlamydia trachomatis
TDVNK

SEQ ID NO: 5453 - protein, 5 aa, Chlamydia trachomatis
DVNKE

SEQ ID NO: 5454 - protein, 5 aa, Chlamydia trachomatis
VNKEF

SEQ ID NO: 5455 - protein, 5 aa, Chlamydia trachomatis
NKEFQ

SEQ ID NO: 5456 - protein, 5 aa, Chlamydia trachomatis
KEFQM

SEQ ID NO: 5457 - protein, 5 aa, Chlamydia trachomatis
EFQMG

SEQ ID NO: 5458 - protein, 5 aa, Chlamydia trachomatis
FQMGA

SEQ ID NO: 5459 - protein, 5 aa, Chlamydia trachomatis
QMGAK

SEQ ID NO: 5460 - protein, 5 aa, Chlamydia trachomatis
MGAKP

SEQ ID NO: 5461 - protein, 5 aa, Chlamydia trachomatis
GAKPT

SEQ ID NO: 5462 - protein, 5 aa, Chlamydia trachomatis
AKPTT

SEQ ID NO: 5463 - protein, 5 aa, Chlamydia trachomatis
KPTTD

SEQ ID NO: 5464 - protein, 5 aa, Chlamydia trachomatis
PTTDT

SEQ ID NO: 5465 - protein, 5 aa, Chlamydia trachomatis
TTDTG

SEQ ID NO: 5466 - protein, 5 aa, Chlamydia trachomatis
TDTGN

SEQ ID NO: 5467 - protein, 5 aa, Chlamydia trachomatis
DTGNS

SEQ ID NO: 5468 - protein, 5 aa, Chlamydia trachomatis
TGNSA

SEQ ID NO: 5469 - protein, 5 aa, Chlamydia trachomatis
GNSAA

SEQ ID NO: 5470 - protein, 5 aa, Chlamydia trachomatis
NSAAP

SEQ ID NO: 5471 - protein, 5 aa, Chlamydia trachomatis
SAAPS

SEQ ID NO: 5472 - protein, 5 aa, Chlamydia trachomatis
AAPST

SEQ ID NO: 5473 - protein, 5 aa, Chlamydia trachomatis
APSTL

SEQ ID NO: 5474 - protein, 5 aa, Chlamydia trachomatis
PSTLT

SEQ ID NO: 5475 - protein, 5 aa, Chlamydia trachomatis
STLTA

SEQ ID NO: 5476 - protein, 5 aa, Chlamydia trachomatis
TLTAR

SEQ ID NO: 5477 - protein, 5 aa, Chlamydia trachomatis
LTARE

SEQ ID NO: 5478 - protein, 5 aa, Chlamydia trachomatis
TAREN

SEQ ID NO: 5479 - protein, 5 aa, Chlamydia trachomatis
ARENP

SEQ ID NO: 5480 - protein, 5 aa, Chlamydia trachomatis
RENPA

SEQ ID NO: 5481 - protein, 5 aa, Chlamydia trachomatis
ENPAY

SEQ ID NO: 5482 - protein, 5 aa, Chlamydia trachomatis
NPAYG

SEQ ID NO: 5483 - protein, 5 aa, Chlamydia trachomatis
PAYGR

SEQ ID NO: 5484 - protein, 5 aa, Chlamydia trachomatis
AYGRH

SEQ ID NO: 5485 - protein, 5 aa, Chlamydia trachomatis
YGRHM

SEQ ID NO: 5486 - protein, 5 aa, Chlamydia trachomatis
GRHMQ

SEQ ID NO: 5487 - protein, 5 aa, Chlamydia trachomatis
RHMQD

SEQ ID NO: 5488 - protein, 5 aa, Chlamydia trachomatis
HMQDA

SEQ ID NO: 5489 - protein, 5 aa, Chlamydia trachomatis
MQDAE

SEQ ID NO: 5490 - protein, 5 aa, Chlamydia trachomatis
QDAEM

SEQ ID NO: 5491 - protein, 5 aa, Chlamydia trachomatis
DAEMF

SEQ ID NO: 5492 - protein, 5 aa, Chlamydia trachomatis
AEMFT

SEQ ID NO: 5493 - protein, 5 aa, Chlamydia trachomatis
EMFTN

SEQ ID NO: 5494 - protein, 5 aa, Chlamydia trachomatis
MFTNA

SEQ ID NO: 5495 - protein, 5 aa, Chlamydia trachomatis
FTNAA

SEQ ID NO: 5496 - protein, 5 aa, Chlamydia trachomatis
TNAAC

SEQ ID NO: 5497 - protein, 5 aa, Chlamydia trachomatis
NAACM

SEQ ID NO: 5498 - protein, 5 aa, Chlamydia trachomatis
AACMA

SEQ ID NO: 5499 - protein, 5 aa, Chlamydia trachomatis
ACMAL

SEQ ID NO: 5500 - protein, 5 aa, Chlamydia trachomatis
CMALN

SEQ ID NO: 5501 - protein, 5 aa, Chlamydia trachomatis [sequence omitted]

SEQ ID NO: 5502 - protein, 5 aa, Chlamydia trachomatis
ALNIW

SEQ ID NO: 5503 - protein, 5 aa, Chlamydia trachomatis
LNIWD

SEQ ID NO: 5504 - protein, 5 aa, Chlamydia trachomatis
NIWDR

SEQ ID NO: 5505 - protein, 5 aa, Chlamydia trachomatis
IWDRF

SEQ ID NO: 5506 - protein, 5 aa, Chlamydia trachomatis
WDRFD

SEQ ID NO: 5507 - protein, 5 aa, Chlamydia trachomatis
DRFDV

SEQ ID NO: 5508 - protein, 5 aa, Chlamydia trachomatis
RFDVF

SEQ ID NO: 5509 - protein, 5 aa, Chlamydia trachomatis
FDVFC

SEQ ID NO: 5510 - protein, 5 aa, Chlamydia trachomatis
DVFCT

SEQ ID NO: 5511 - protein, 5 aa, Chlamydia trachomatis
VFCTL

SEQ ID NO: 5512 - protein, 5 aa, Chlamydia trachomatis
FCTLG

SEQ ID NO: 5513 - protein, 5 aa, Chlamydia trachomatis
CTLGA

SEQ ID NO: 5514 - protein, 5 aa, Chlamydia trachomatis
TLGAT

SEQ ID NO: 5515 - protein, 5 aa, Chlamydia trachomatis
LGATS

SEQ ID NO: 5516 - protein, 5 aa, Chlamydia trachomatis
GATSG

SEQ ID NO: 5517 - protein, 5 aa, Chlamydia trachomatis
ATSGY

SEQ ID NO: 5518 - protein, 5 aa, Chlamydia trachomatis
TSGYL

SEQ ID NO: 5519 - protein, 5 aa, Chlamydia trachomatis
SGYLK

SEQ ID NO: 5520 - protein, 5 aa, Chlamydia trachomatis
GYLKG

SEQ ID NO: 5521 - protein, 5 aa, Chlamydia trachomatis
YLKGN

SEQ ID NO: 5522 - protein, 5 aa, Chlamydia trachomatis
LKGNS

SEQ ID NO: 5523 - protein, 5 aa, Chlamydia trachomatis
KGNSA

SEQ ID NO: 5524 - protein, 5 aa, Chlamydia trachomatis
GNSAS

SEQ ID NO: 5525 - protein, 5 aa, Chlamydia trachomatis
NSASF

SEQ ID NO: 5526 - protein, 5 aa, Chlamydia trachomatis
SASFN

SEQ ID NO: 5527 - protein, 5 aa, Chlamydia trachomatis
ASFNL

SEQ ID NO: 5528 - protein, 5 aa, Chlamydia trachomatis
SFNLV

SEQ ID NO: 5529 - protein, 5 aa, Chlamydia trachomatis
FNLVG

SEQ ID NO: 5530 - protein, 5 aa, Chlamydia trachomatis
NLVGL

SEQ ID NO: 5531 - protein, 5 aa, Chlamydia trachomatis
LVGLF

SEQ ID NO: 5532 - protein, 5 aa, Chlamydia trachomatis
VGLFG

SEQ ID NO: 5533 - protein, 5 aa, Chlamydia trachomatis
GLFGD

SEQ ID NO: 5534 - protein, 5 aa, Chlamydia trachomatis
LFGDN

SEQ ID NO: 5535 - protein, 5 aa, Chlamydia trachomatis
FGDNE

SEQ ID NO: 5536 - protein, 5 aa, Chlamydia trachomatis
GDNEN

SEQ ID NO: 5537 - protein, 5 aa, Chlamydia trachomatis
DNENQ

SEQ ID NO: 5538 - protein, 5 aa, Chlamydia trachomatis
NENQK

SEQ ID NO: 5539 - protein, 5 aa, Chlamydia trachomatis
ENQKT

SEQ ID NO: 5540 - protein, 5 aa, Chlamydia trachomatis
NQKTV

SEQ ID NO: 5541 - protein, 5 aa, Chlamydia trachomatis
QKTVK

SEQ ID NO: 5542 - protein, 5 aa, Chlamydia trachomatis
KTVKA

SEQ ID NO: 5543 - protein, 5 aa, Chlamydia trachomatis
TVKAE

SEQ ID NO: 5544 - protein, 5 aa, Chlamydia trachomatis
VKAES

SEQ ID NO: 5545 - protein, 5 aa, Chlamydia trachomatis
KAESV

SEQ ID NO: 5546 - protein, 5 aa, Chlamydia trachomatis
AESVP

SEQ ID NO: 5547 - protein, 5 aa, Chlamydia trachomatis
ESVPN

SEQ ID NO: 5548 - protein, 5 aa, Chlamydia trachomatis
SVPNM

SEQ ID NO: 5549 - protein, 5 aa, Chlamydia trachomatis
VPNMS

SEQ ID NO: 5550 - protein, 5 aa, Chlamydia trachomatis
PNMSF

SEQ ID NO: 5551 - protein, 5 aa, Chlamydia trachomatis
NMSFD

SEQ ID NO: 5552 - protein, 5 aa, Chlamydia trachomatis
MSFDQ

SEQ ID NO: 5553 - protein, 5 aa, Chlamydia trachomatis
SFDQS

SEQ ID NO: 5554 - protein, 5 aa, Chlamydia trachomatis
FDQSV

SEQ ID NO: 5555 - protein, 5 aa, Chlamydia trachomatis
DQSVV

SEQ ID NO: 5556 - protein, 5 aa, Chlamydia trachomatis
QSVVE

SEQ ID NO: 5557 - protein, 5 aa, Chlamydia trachomatis
SVVEL

SEQ ID NO: 5558 - protein, 5 aa, Chlamydia trachomatis
VVELY

SEQ ID NO: 5559 - protein, 5 aa, Chlamydia trachomatis
VELYT

SEQ ID NO: 5560 - protein, 5 aa, Chlamydia trachomatis
ELYTD

SEQ ID NO: 5561 - protein, 5 aa, Chlamydia trachomatis
LYTDT

SEQ ID NO: 5562 - protein, 5 aa, Chlamydia trachomatis
YTDTT

SEQ ID NO: 5563 - protein, 5 aa, Chlamydia trachomatis
TDTTF

SEQ ID NO: 5564 - protein, 5 aa, Chlamydia trachomatis
DTTFA

SEQ ID NO: 5565 - protein, 5 aa, Chlamydia trachomatis
TTFAW

SEQ ID NO: 5566 - protein, 5 aa, Chlamydia trachomatis
TFAWS

SEQ ID NO: 5567 - protein, 5 aa, Chlamydia trachomatis
FAWSV

SEQ ID NO: 5568 - protein, 5 aa, Chlamydia trachomatis
AWSVG

SEQ ID NO: 5569 - protein, 5 aa, Chlamydia trachomatis
WSVGA

SEQ ID NO: 5570 - protein, 5 aa, Chlamydia trachomatis
SVGAR

SEQ ID NO: 5571 - protein, 5 aa, Chlamydia trachomatis
VGARA

SEQ ID NO: 5572 - protein, 5 aa, Chlamydia trachomatis
GARAA

SEQ ID NO: 5573 - protein, 5 aa, Chlamydia trachomatis
ARAAL

SEQ ID NO: 5574 - protein, 5 aa, Chlamydia trachomatis
RAALW

SEQ ID NO: 5575 - protein, 5 aa, Chlamydia trachomatis
AALWE

SEQ ID NO: 5576 - protein, 5 aa, Chlamydia trachomatis
ALWEC

SEQ ID NO: 5577 - protein, 5 aa, Chlamydia trachomatis
LWECG

SEQ ID NO: 5578 - protein, 5 aa, Chlamydia trachomatis
WECGC

SEQ ID NO: 5579 - protein, 5 aa, Chlamydia trachomatis
ECGCA

SEQ ID NO: 5580 - protein, 5 aa, Chlamydia trachomatis
CGCAT

SEQ ID NO: 5581 - protein, 5 aa, Chlamydia trachomatis
GCATL

SEQ ID NO: 5582 - protein, 5 aa, Chlamydia trachomatis
CATLG

SEQ ID NO: 5583 - protein, 5 aa, Chlamydia trachomatis
ATLGA

SEQ ID NO: 5584 - protein, 5 aa, Chlamydia trachomatis
TLGAS

SEQ ID NO: 5585 - protein, 5 aa, Chlamydia trachomatis
LGASF

SEQ ID NO: 5586 - protein, 5 aa, Chlamydia trachomatis
GASFQ

SEQ ID NO: 5587 - protein, 5 aa, Chlamydia trachomatis
ASFQY

SEQ ID NO: 5588 - protein, 5 aa, Chlamydia trachomatis
SFQYA

SEQ ID NO: 5589 - protein, 5 aa, Chlamydia trachomatis
FQYAQ

SEQ ID NO: 5590 - protein, 5 aa, Chlamydia trachomatis
QYAQS

SEQ ID NO: 5591 - protein, 5 aa, Chlamydia trachomatis
YAQSK

SEQ ID NO: 5592 - protein, 5 aa, Chlamydia trachomatis
AQSKP

SEQ ID NO: 5593 - protein, 5 aa, Chlamydia trachomatis
QSKPK

SEQ ID NO: 5594 - protein, 5 aa, Chlamydia trachomatis
SKPKV

SEQ ID NO: 5595 - protein, 5 aa, Chlamydia trachomatis
KPKVE

SEQ ID NO: 5596 - protein, 5 aa, Chlamydia trachomatis
PKVEE

SEQ ID NO: 5597 - protein, 5 aa, Chlamydia trachomatis
KVEEL

SEQ ID NO: 5598 - protein, 5 aa, Chlamydia trachomatis
VEELN

SEQ ID NO: 5599 - protein, 5 aa, Chlamydia trachomatis
EELNV

SEQ ID NO: 5600 - protein, 5 aa, Chlamydia trachomatis
ELNVL

SEQ ID NO: 5601 - protein, 5 aa, Chlamydia trachomatis
LNVLC

SEQ ID NO: 5602 - protein, 5 aa, Chlamydia trachomatis
NVLCN

SEQ ID NO: 5603 - protein, 5 aa, Chlamydia trachomatis
VLCNA

SEQ ID NO: 5604 - protein, 5 aa, Chlamydia trachomatis
LCNAA

SEQ ID NO: 5605 - protein, 5 aa, Chlamydia trachomatis
CNAAE

SEQ ID NO: 5606 - protein, 5 aa, Chlamydia trachomatis
NAAEF

SEQ ID NO: 5607 - protein, 5 aa, Chlamydia trachomatis
AAEFT

SEQ ID NO: 5608 - protein, 5 aa, Chlamydia trachomatis
AEFTI

SEQ ID NO: 5609 - protein, 5 aa, Chlamydia trachomatis
EFTIN

SEQ ID NO: 5610 - protein, 5 aa, Chlamydia trachomatis
FTINK

SEQ ID NO: 5611 - protein, 5 aa, Chlamydia trachomatis
TINKP

SEQ ID NO: 5612 - protein, 5 aa, Chlamydia trachomatis
INKPK

SEQ ID NO: 5613 - protein, 5 aa, Chlamydia trachomatis
NKPKG

SEQ ID NO: 5614 - protein, 5 aa, Chlamydia trachomatis
KPKGY

SEQ ID NO: 5615 - protein, 5 aa, Chlamydia trachomatis
PKGYV

SEQ ID NO: 5616 - protein, 5 aa, Chlamydia trachomatis
KGYVG

SEQ ID NO: 5617 - protein, 5 aa, Chlamydia trachomatis
GYVGK

SEQ ID NO: 5618 - protein, 5 aa, Chlamydia trachomatis
YVGKE

SEQ ID NO: 5619 - protein, 5 aa, Chlamydia trachomatis
VGKEF

SEQ ID NO: 5620 - protein, 5 aa, Chlamydia trachomatis
GKEFP

SEQ ID NO: 5621 - protein, 5 aa, Chlamydia trachomatis
KEFPL

SEQ ID NO: 5622 - protein, 5 aa, Chlamydia trachomatis
EFPLD

SEQ ID NO: 5623 - protein, 5 aa, Chlamydia trachomatis
FPLDL

SEQ ID NO: 5624 - protein, 5 aa, Chlamydia trachomatis
PLDLT

SEQ ID NO: 5625 - protein, 5 aa, Chlamydia trachomatis
LDLTA

SEQ ID NO: 5626 - protein, 5 aa, Chlamydia trachomatis
DLTAG

SEQ ID NO: 5627 - protein, 5 aa, Chlamydia trachomatis
LTAGT

SEQ ID NO: 5628 - protein, 5 aa, Chlamydia trachomatis
TAGTD

SEQ ID NO: 5629 - protein, 5 aa, Chlamydia trachomatis
AGTDA

SEQ ID NO: 5630 - protein, 5 aa, Chlamydia trachomatis
GTDAA

SEQ ID NO: 5631 - protein, 5 aa, Chlamydia trachomatis
TDAAT

SEQ ID NO: 5632 - protein, 5 aa, Chlamydia trachomatis
DAATG

SEQ ID NO: 5633 - protein, 5 aa, Chlamydia trachomatis
AATGT

SEQ ID NO: 5634 - protein, 5 aa, Chlamydia trachomatis
ATGTK

SEQ ID NO: 5635 - protein, 5 aa, Chlamydia trachomatis
TGTKD

SEQ ID NO: 5636 - protein, 5 aa, Chlamydia trachomatis
GTKDA

SEQ ID NO: 5637 - protein, 5 aa, Chlamydia trachomatis
TKDAS

SEQ ID NO: 5638 - protein, 5 aa, Chlamydia trachomatis
KDASI

SEQ ID NO: 5639 - protein, 5 aa, Chlamydia trachomatis
DASID

SEQ ID NO: 5640 - protein, 5 aa, Chlamydia trachomatis
ASIDY

SEQ ID NO: 5641 - protein, 5 aa, Chlamydia trachomatis
SIDYH

SEQ ID NO: 5642 - protein, 5 aa, Chlamydia trachomatis
IDYHE

SEQ ID NO: 5643 - protein, 5 aa, Chlamydia trachomatis
DYHEW

SEQ ID NO: 5644 - protein, 5 aa, Chlamydia trachomatis
YHEWQ

SEQ ID NO: 5645 - protein, 5 aa, Chlamydia trachomatis
HEWQA

SEQ ID NO: 5646 - protein, 5 aa, Chlamydia trachomatis
EWQAS

SEQ ID NO: 5647 - protein, 5 aa, Chlamydia trachomatis
WQASL

SEQ ID NO: 5648 - protein, 5 aa, Chlamydia trachomatis
QASLA

SEQ ID NO: 5649 - protein, 5 aa, Chlamydia trachomatis
ASLAL

SEQ ID NO: 5650 - protein, 5 aa, Chlamydia trachomatis
SLALS

SEQ ID NO: 5651 - protein, 5 aa, Chlamydia trachomatis
LALSY

SEQ ID NO: 5652 - protein, 5 aa, Chlamydia trachomatis
ALSYR

SEQ ID NO: 5653 - protein, 5 aa, Chlamydia trachomatis
LSYRL

SEQ ID NO: 5654 - protein, 5 aa, Chlamydia trachomatis
SYRLN

SEQ ID NO: 5655 - protein, 5 aa, Chlamydia trachomatis
YRLNM

SEQ ID NO: 5656 - protein, 5 aa, Chlamydia trachomatis
RLNMF

SEQ ID NO: 5657 - protein, 5 aa, Chlamydia trachomatis
LNMFT

SEQ ID NO: 5658 - protein, 5 aa, Chlamydia trachomatis
NMFTP

SEQ ID NO: 5659 - protein, 5 aa, Chlamydia trachomatis
MFTPY

SEQ ID NO: 5660 - protein, 5 aa, Chlamydia trachomatis
FTPYI

SEQ ID NO: 5661 - protein, 5 aa, Chlamydia trachomatis
TPYIG

SEQ ID NO: 5662 - protein, 5 aa, Chlamydia trachomatis
PYIGV

SEQ ID NO: 5663 - protein, 5 aa, Chlamydia trachomatis
YIGVK

SEQ ID NO: 5664 - protein, 5 aa, Chlamydia trachomatis
IGVKW

SEQ ID NO: 5665 - protein, 5 aa, Chlamydia trachomatis
GVKWS

SEQ ID NO: 5666 - protein, 5 aa, Chlamydia trachomatis
VKWSR

SEQ ID NO: 5667 - protein, 5 aa, Chlamydia trachomatis
KWSRA

SEQ ID NO: 5668 - protein, 5 aa, Chlamydia trachomatis
WSRAS

SEQ ID NO: 5669 - protein, 5 aa, Chlamydia trachomatis
SRASF

SEQ ID NO: 5670 - protein, 5 aa, Chlamydia trachomatis
RASFD

SEQ ID NO: 5671 - protein, 5 aa, Chlamydia trachomatis
ASFDA

SEQ ID NO: 5672 - protein, 5 aa, Chlamydia trachomatis
SFDAD

SEQ ID NO: 5673 - protein, 5 aa, Chlamydia trachomatis
FDADT

SEQ ID NO: 5674 - protein, 5 aa, Chlamydia trachomatis
DADTI

SEQ ID NO: 5675 - protein, 5 aa, Chlamydia trachomatis
ADTIR

SEQ ID NO: 5676 - protein, 5 aa, Chlamydia trachomatis
DTIRI

SEQ ID NO: 5677 - protein, 5 aa, Chlamydia trachomatis
TIRIA

SEQ ID NO: 5678 - protein, 5 aa, Chlamydia trachomatis
IRIAQ

SEQ ID NO: 5679 - protein, 5 aa, Chlamydia trachomatis
RIAQP

SEQ ID NO: 5680 - protein, 5 aa, Chlamydia trachomatis
IAQPK

SEQ ID NO: 5681 - protein, 5 aa, Chlamydia trachomatis
AQPKS

SEQ ID NO: 5682 - protein, 5 aa, Chlamydia trachomatis
QPKSA

SEQ ID NO: 5683 - protein, 5 aa, Chlamydia trachomatis
PKSAT

SEQ ID NO: 5684 - protein, 5 aa, Chlamydia trachomatis
KSATA

SEQ ID NO: 5685 - protein, 5 aa, Chlamydia trachomatis
SATAI

SEQ ID NO: 5686 - protein, 5 aa, Chlamydia trachomatis
ATAIF

SEQ ID NO: 5687 - protein, 5 aa, Chlamydia trachomatis
TAIFD

SEQ ID NO: 5688 - protein, 5 aa, Chlamydia trachomatis
AIFDT

SEQ ID NO: 5689 - protein, 5 aa, Chlamydia trachomatis
IFDTT

SEQ ID NO: 5690 - protein, 5 aa, Chlamydia trachomatis
FDTTT

SEQ ID NO: 5691 - protein, 5 aa, Chlamydia trachomatis
DTTTL

SEQ ID NO: 5692 - protein, 5 aa, Chlamydia trachomatis
TTTLN

SEQ ID NO: 5693 - protein, 5 aa, Chlamydia trachomatis
TTLNP

SEQ ID NO: 5694 - protein, 5 aa, Chlamydia trachomatis
TLNPT

SEQ ID NO: 5695 - protein, 5 aa, Chlamydia trachomatis
LNPTI

SEQ ID NO: 5696 - protein, 5 aa, Chlamydia trachomatis
NPTIA

SEQ ID NO: 5697 - protein, 5 aa, Chlamydia trachomatis
PTIAG

SEQ ID NO: 5698 - protein, 5 aa, Chlamydia trachomatis
TIAGA

SEQ ID NO: 5699 - protein, 5 aa, Chlamydia trachomatis
IAGAG

SEQ ID NO: 5700 - protein, 5 aa, Chlamydia trachomatis
AGAGD

SEQ ID NO: 5701 - protein, 5 aa, Chlamydia trachomatis
GAGDV

SEQ ID NO: 5702 - protein, 5 aa, Chlamydia trachomatis
AGDVK

SEQ ID NO: 5703 - protein, 5 aa, Chlamydia trachomatis
GDVKT

SEQ ID NO: 5704 - protein, 5 aa, Chlamydia trachomatis
DVKTG

SEQ ID NO: 5705 - protein, 5 aa, Chlamydia trachomatis
VKTGA

SEQ ID NO: 5706 - protein, 5 aa, Chlamydia trachomatis
KTGAE

SEQ ID NO: 5707 - protein, 5 aa, Chlamydia trachomatis
TGAEG

SEQ ID NO: 5708 - protein, 5 aa, Chlamydia trachomatis
GAEGQ

SEQ ID NO: 5709 - protein, 5 aa, Chlamydia trachomatis
AEGQL

SEQ ID NO: 5710 - protein, 5 aa, Chlamydia trachomatis
EGQLG

SEQ ID NO: 5711 - protein, 5 aa, Chlamydia trachomatis
GQLGD

SEQ ID NO: 5712 - protein, 5 aa, Chlamydia trachomatis
QLGDT

SEQ ID NO: 5713 - protein, 5 aa, Chlamydia trachomatis
LGDTM

SEQ ID NO: 5714 - protein, 5 aa, Chlamydia trachomatis
GDTMQ

SEQ ID NO: 5715 - protein, 5 aa, Chlamydia trachomatis
DTMQI

SEQ ID NO: 5716 - protein, 5 aa, Chlamydia trachomatis
TMQIV

SEQ ID NO: 5717 - protein, 5 aa, Chlamydia trachomatis
MQIVS

SEQ ID NO: 5718 - protein, 5 aa, Chlamydia trachomatis
QIVSL

SEQ ID NO: 5719 - protein, 5 aa, Chlamydia trachomatis
IVSLQ

SEQ ID NO: 5720 - protein, 5 aa, Chlamydia trachomatis
VSLQL

SEQ ID NO: 5721 - protein, 5 aa, Chlamydia trachomatis
SLQLN

SEQ ID NO: 5722 - protein, 5 aa, Chlamydia trachomatis
LQLNK

SEQ ID NO: 5723 - protein, 5 aa, Chlamydia trachomatis
QLNKM

SEQ ID NO: 5724 - protein, 5 aa, Chlamydia trachomatis
LNKMK

SEQ ID NO: 5725 - protein, 5 aa, Chlamydia trachomatis
NKMKS

SEQ ID NO: 5726 - protein, 5 aa, Chlamydia trachomatis
KMKSR

SEQ ID NO: 5727 - protein, 5 aa, Chlamydia trachomatis
MKSRK

SEQ ID NO: 5728 - protein, 5 aa, Chlamydia trachomatis
KSRKS

SEQ ID NO: 5729 - protein, 5 aa, Chlamydia trachomatis
SRKSC

SEQ ID NO: 5730 - protein, 5 aa, Chlamydia trachomatis
RKSCG

SEQ ID NO: 5731 - protein, 5 aa, Chlamydia trachomatis
KSCGI

SEQ ID NO: 5732 - protein, 5 aa, Chlamydia trachomatis
SCGIA

SEQ ID NO: 5733 - protein, 5 aa, Chlamydia trachomatis
CGIAV

SEQ ID NO: 5734 - protein, 5 aa, Chlamydia trachomatis
GIAVG

SEQ ID NO: 5735 - protein, 5 aa, Chlamydia trachomatis
IAVGT

SEQ ID NO: 5736 - protein, 5 aa, Chlamydia trachomatis
AVGTT

SEQ ID NO: 5737 - protein, 5 aa, Chlamydia trachomatis
VGTTI

SEQ ID NO: 5738 - protein, 5 aa, Chlamydia trachomatis
GTTIV

SEQ ID NO: 5739 - protein, 5 aa, Chlamydia trachomatis
TTIVD

SEQ ID NO: 5740 - protein, 5 aa, Chlamydia trachomatis
TIVDA

SEQ ID NO: 5741 - protein, 5 aa, Chlamydia trachomatis
IVDAD

SEQ ID NO: 5742 - protein, 5 aa, Chlamydia trachomatis
VDADK

SEQ ID NO: 5743 - protein, 5 aa, Chlamydia trachomatis
DADKY

SEQ ID NO: 5744 - protein, 5 aa, Chlamydia trachomatis
ADKYA

SEQ ID NO: 5745 - protein, 5 aa, Chlamydia trachomatis
DKYAV

SEQ ID NO: 5746 - protein, 5 aa, Chlamydia trachomatis
KYAVT

SEQ ID NO: 5747 - protein, 5 aa, Chlamydia trachomatis
YAVTV

SEQ ID NO: 5748 - protein, 5 aa, Chlamydia trachomatis
AVTVE

SEQ ID NO: 5749 - protein, 5 aa, Chlamydia trachomatis
VTVET

SEQ ID NO: 5750 - protein, 5 aa, Chlamydia trachomatis
TVETR

SEQ ID NO: 5751 - protein, 5 aa, Chlamydia trachomatis
VETRL

SEQ ID NO: 5752 - protein, 5 aa, Chlamydia trachomatis
ETRLI

SEQ ID NO: 5753 - protein, 5 aa, Chlamydia trachomatis
TRLID

SEQ ID NO: 5754 - protein, 5 aa, Chlamydia trachomatis
RLIDE

SEQ ID NO: 5755 - protein, 5 aa, Chlamydia trachomatis
LIDER

SEQ ID NO: 5756 - protein, 5 aa, Chlamydia trachomatis
IDERA

SEQ ID NO: 5757 - protein, 5 aa, Chlamydia trachomatis
DERAA

SEQ ID NO: 5758 - protein, 5 aa, Chlamydia trachomatis
ERAAH

SEQ ID NO: 5759 - protein, 5 aa, Chlamydia trachomatis
RAAHV

SEQ ID NO: 5760 - protein, 5 aa, Chlamydia trachomatis
AAHVN

SEQ ID NO: 5761 - protein, 5 aa, Chlamydia trachomatis
AHVNA

SEQ ID NO: 5762 - protein, 5 aa, Chlamydia trachomatis
HVNAQ

SEQ ID NO: 5763 - protein, 5 aa, Chlamydia trachomatis
VNAQF

SEQ ID NO: 5764 - protein, 5 aa, Chlamydia trachomatis
NAQFR

SEQ ID NO: 5765 - protein, 5 aa, Chlamydia trachomatis
AQFRF

SEQ ID NO: 5766 - protein, 5 aa, Chlamydia trachomatis
MTTPT

SEQ ID NO: 5767 - protein, 5 aa, Chlamydia trachomatis
TTPTL

SEQ ID NO: 5768 - protein, 5 aa, Chlamydia trachomatis
TPTLI

SEQ ID NO: 5769 - protein, 5 aa, Chlamydia trachomatis
PTLIV

SEQ ID NO: 5770 - protein, 5 aa, Chlamydia trachomatis
TLIVT

SEQ ID NO: 5771 - protein, 5 aa, Chlamydia trachomatis
LIVTP

SEQ ID NO: 5772 - protein, 5 aa, Chlamydia trachomatis
IVTPP

SEQ ID NO: 5773 - protein, 5 aa, Chlamydia trachomatis
VTPPS

SEQ ID NO: 5774 - protein, 5 aa, Chlamydia trachomatis
TPPSP

SEQ ID NO: 5775 - protein, 5 aa, Chlamydia trachomatis
PPSPP

SEQ ID NO: 5776 - protein, 5 aa, Chlamydia trachomatis
PSPPA

SEQ ID NO: 5777 - protein, 5 aa, Chlamydia trachomatis
SPPAP

SEQ ID NO: 5778 - protein, 5 aa, Chlamydia trachomatis
PPAPS

SEQ ID NO: 5779 - protein, 5 aa, Chlamydia trachomatis
PAPSY

SEQ ID NO: 5780 - protein, 5 aa, Chlamydia trachomatis
APSYS

SEQ ID NO: 5781 - protein, 5 aa, Chlamydia trachomatis
PSYSA

SEQ ID NO: 5782 - protein, 5 aa, Chlamydia trachomatis
SYSAN

SEQ ID NO: 5783 - protein, 5 aa, Chlamydia trachomatis
YSANR

SEQ ID NO: 5784 - protein, 5 aa, Chlamydia trachomatis
SANRV

SEQ ID NO: 5785 - protein, 5 aa, Chlamydia trachomatis
ANRVP

SEQ ID NO: 5786 - protein, 5 aa, Chlamydia trachomatis
NRVPQ

SEQ ID NO: 5787 - protein, 5 aa, Chlamydia trachomatis
RVPQP

SEQ ID NO: 5788 - protein, 5 aa, Chlamydia trachomatis
VPQPS

SEQ ID NO: 5789 - protein, 5 aa, Chlamydia trachomatis
PQPSL

SEQ ID NO: 5790 - protein, 5 aa, Chlamydia trachomatis
QPSLM

SEQ ID NO: 5791 - protein, 5 aa, Chlamydia trachomatis
PSLMD

SEQ ID NO: 5792 - protein, 5 aa, Chlamydia trachomatis
SLMDK

SEQ ID NO: 5793 - protein, 5 aa, Chlamydia trachomatis
LMDKI

SEQ ID NO: 5794 - protein, 5 aa, Chlamydia trachomatis
MDKIK

SEQ ID NO: 5795 - protein, 5 aa, Chlamydia trachomatis
DKIKK

SEQ ID NO: 5796 - protein, 5 aa, Chlamydia trachomatis
KIKKI

SEQ ID NO: 5797 - protein, 5 aa, Chlamydia trachomatis
IKKIA

SEQ ID NO: 5798 - protein, 5 aa, Chlamydia trachomatis
KKIAA

SEQ ID NO: 5799 - protein, 5 aa, Chlamydia trachomatis
KIAAI

SEQ ID NO: 5800 - protein, 5 aa, Chlamydia trachomatis
IAAIA

SEQ ID NO: 5801 - protein, 5 aa, Chlamydia trachomatis
AAIAS

SEQ ID NO: 5802 - protein, 5 aa, Chlamydia trachomatis
AIASL

SEQ ID NO: 5803 - protein, 5 aa, Chlamydia trachomatis
IASLI

SEQ ID NO: 5804 - protein, 5 aa, Chlamydia trachomatis
ASLIL

SEQ ID NO: 5805 - protein, 5 aa, Chlamydia trachomatis
SLILI

SEQ ID NO: 5806 - protein, 5 aa, Chlamydia trachomatis
LILIG

SEQ ID NO: 5807 - protein, 5 aa, Chlamydia trachomatis
ILIGT

SEQ ID NO: 5808 - protein, 5 aa, Chlamydia trachomatis
LIGTI

SEQ ID NO: 5809 - protein, 5 aa, Chlamydia trachomatis
IGTIG

SEQ ID NO: 5810 - protein, 5 aa, Chlamydia trachomatis
GTIGF

SEQ ID NO: 5811 - protein, 5 aa, Chlamydia trachomatis
TIGFL

SEQ ID NO: 5812 - protein, 5 aa, Chlamydia trachomatis
IGFLA

SEQ ID NO: 5813 - protein, 5 aa, Chlamydia trachomatis
GFLAL

SEQ ID NO: 5814 - protein, 5 aa, Chlamydia trachomatis
FLALL

SEQ ID NO: 5815 - protein, 5 aa, Chlamydia trachomatis
LALLG

SEQ ID NO: 5816 - protein, 5 aa, Chlamydia trachomatis
ALLGH

SEQ ID NO: 5817 - protein, 5 aa, Chlamydia trachomatis
LLGHL

SEQ ID NO: 5818 - protein, 5 aa, Chlamydia trachomatis
LGHLV

SEQ ID NO: 5819 - protein, 5 aa, Chlamydia trachomatis
GHLVG

SEQ ID NO: 5820 - protein, 5 aa, Chlamydia trachomatis
HLVGF

SEQ ID NO: 5821 - protein, 5 aa, Chlamydia trachomatis
LVGFL

SEQ ID NO: 5822 - protein, 5 aa, Chlamydia trachomatis
VGFLI

SEQ ID NO: 5823 - protein, 5 aa, Chlamydia trachomatis
GFLIA

SEQ ID NO: 5824 - protein, 5 aa, Chlamydia trachomatis
FLIAP

SEQ ID NO: 5825 - protein, 5 aa, Chlamydia trachomatis
LIAPQ

SEQ ID NO: 5826 - protein, 5 aa, Chlamydia trachomatis
IAPQI

SEQ ID NO: 5827 - protein, 5 aa, Chlamydia trachomatis
APQIT

SEQ ID NO: 5828 - protein, 5 aa, Chlamydia trachomatis
PQITI

SEQ ID NO: 5829 - protein, 5 aa, Chlamydia trachomatis
QITIV

SEQ ID NO: 5830 - protein, 5 aa, Chlamydia trachomatis
ITIVL

SEQ ID NO: 5831 - protein, 5 aa, Chlamydia trachomatis
TIVLL

SEQ ID NO: 5832 - protein, 5 aa, Chlamydia trachomatis
IVLLA

SEQ ID NO: 5833 - protein, 5 aa, Chlamydia trachomatis
VLLAL

SEQ ID NO: 5834 - protein, 5 aa, Chlamydia trachomatis
LLALF

SEQ ID NO: 5835 - protein, 5 aa, Chlamydia trachomatis
LALFI

SEQ ID NO: 5836 - protein, 5 aa, Chlamydia trachomatis
ALFII

SEQ ID NO: 5837 - protein, 5 aa, Chlamydia trachomatis
LFIIS

SEQ ID NO: 5838 - protein, 5 aa, Chlamydia trachomatis
FIISL

SEQ ID NO: 5839 - protein, 5 aa, Chlamydia trachomatis
IISLA

SEQ ID NO: 5840 - protein, 5 aa, Chlamydia trachomatis
ISLAG

SEQ ID NO: 5841 - protein, 5 aa, Chlamydia trachomatis
SLAGN

SEQ ID NO: 5842 - protein, 5 aa, Chlamydia trachomatis
LAGNA

SEQ ID NO: 5843 - protein, 5 aa, Chlamydia trachomatis
AGNAL

SEQ ID NO: 5844 - protein, 5 aa, Chlamydia trachomatis
GNALY

SEQ ID NO: 5845 - protein, 5 aa, Chlamydia trachomatis
NALYL

SEQ ID NO: 5846 - protein, 5 aa, Chlamydia trachomatis
ALYLQ

SEQ ID NO: 5847 - protein, 5 aa, Chlamydia trachomatis
LYLQK

SEQ ID NO: 5848 - protein, 5 aa, Chlamydia trachomatis
YLQKT

SEQ ID NO: 5849 - protein, 5 aa, Chlamydia trachomatis
LQKTA

SEQ ID NO: 5850 - protein, 5 aa, Chlamydia trachomatis
QKTAN

SEQ ID NO: 5851 - protein, 5 aa, Chlamydia trachomatis
KTANL

SEQ ID NO: 5852 - protein, 5 aa, Chlamydia trachomatis
TANLH

SEQ ID NO: 5853 - protein, 5 aa, Chlamydia trachomatis
ANLHL

SEQ ID NO: 5854 - protein, 5 aa, Chlamydia trachomatis
NLHLY

SEQ ID NO: 5855 - protein, 5 aa, Chlamydia trachomatis
LHLYQ

SEQ ID NO: 5856 - protein, 5 aa, Chlamydia trachomatis
HLYQD

SEQ ID NO: 5857 - protein, 5 aa, Chlamydia trachomatis
LYQDL

SEQ ID NO: 5858 - protein, 5 aa, Chlamydia trachomatis
YQDLQ

SEQ ID NO: 5859 - protein, 5 aa, Chlamydia trachomatis
QDLQR

SEQ ID NO: 5860 - protein, 5 aa, Chlamydia trachomatis
DLQRE

SEQ ID NO: 5861 - protein, 5 aa, Chlamydia trachomatis
LQREV

SEQ ID NO: 5862 - protein, 5 aa, Chlamydia trachomatis
QREVG

SEQ ID NO: 5863 - protein, 5 aa, Chlamydia trachomatis
REVGS

SEQ ID NO: 5864 - protein, 5 aa, Chlamydia trachomatis
EVGSL

SEQ ID NO: 5865 - protein, 5 aa, Chlamydia trachomatis
VGSLK

SEQ ID NO: 5866 - protein, 5 aa, Chlamydia trachomatis
GSLKE

SEQ ID NO: 5867 - protein, 5 aa, Chlamydia trachomatis
SLKEI

SEQ ID NO: 5868 - protein, 5 aa, Chlamydia trachomatis
LKEIN

SEQ ID NO: 5869 - protein, 5 aa, Chlamydia trachomatis
KEINF

SEQ ID NO: 5870 - protein, 5 aa, Chlamydia trachomatis
EINFM

SEQ ID NO: 5871 - protein, 5 aa, Chlamydia trachomatis
INFML

SEQ ID NO: 5872 - protein, 5 aa, Chlamydia trachomatis
NFMLS

SEQ ID NO: 5873 - protein, 5 aa, Chlamydia trachomatis
FMLSV

SEQ ID NO: 5874 - protein, 5 aa, Chlamydia trachomatis
MLSVL

SEQ ID NO: 5875 - protein, 5 aa, Chlamydia trachomatis
LSVLQ

SEQ ID NO: 5876 - protein, 5 aa, Chlamydia trachomatis
SVLQK

SEQ ID NO: 5877 - protein, 5 aa, Chlamydia trachomatis
VLQKE

SEQ ID NO: 5878 - protein, 5 aa, Chlamydia trachomatis
LQKEF

SEQ ID NO: 5879 - protein, 5 aa, Chlamydia trachomatis
QKEFL

SEQ ID NO: 5880 - protein, 5 aa, Chlamydia trachomatis
KEFLH

SEQ ID NO: 5881 - protein, 5 aa, Chlamydia trachomatis
EFLHL

SEQ ID NO: 5882 - protein, 5 aa, Chlamydia trachomatis
FLHLS

SEQ ID NO: 5883 - protein, 5 aa, Chlamydia trachomatis
LHLSK

SEQ ID NO: 5884 - protein, 5 aa, Chlamydia trachomatis
HLSKE

SEQ ID NO: 5885 - protein, 5 aa, Chlamydia trachomatis
LSKEF

SEQ ID NO: 5886 - protein, 5 aa, Chlamydia trachomatis
SKEFA

SEQ ID NO: 5887 - protein, 5 aa, Chlamydia trachomatis
KEFAT

SEQ ID NO: 5888 - protein, 5 aa, Chlamydia trachomatis
EFATT

SEQ ID NO: 5889 - protein, 5 aa, Chlamydia trachomatis
FATTS

SEQ ID NO: 5890 - protein, 5 aa, Chlamydia trachomatis
ATTSK

SEQ ID NO: 5891 - protein, 5 aa, Chlamydia trachomatis
TTSKD

SEQ ID NO: 5892 - protein, 5 aa, Chlamydia trachomatis
TSKDL

SEQ ID NO: 5893 - protein, 5 aa, Chlamydia trachomatis
SKDLS

SEQ ID NO: 5894 - protein, 5 aa, Chlamydia trachomatis
KDLSA

SEQ ID NO: 5895 - protein, 5 aa, Chlamydia trachomatis
DLSAV

SEQ ID NO: 5896 - protein, 5 aa, Chlamydia trachomatis
LSAVS

SEQ ID NO: 5897 - protein, 5 aa, Chlamydia trachomatis
SAVSQ

SEQ ID NO: 5898 - protein, 5 aa, Chlamydia trachomatis
AVSQD

SEQ ID NO: 5899 - protein, 5 aa, Chlamydia trachomatis
VSQDF

SEQ ID NO: 5900 - protein, 5 aa, Chlamydia trachomatis
SQDFY

SEQ ID NO: 5901 - protein, 5 aa, Chlamydia trachomatis
QDFYS

SEQ ID NO: 5902 - protein, 5 aa, Chlamydia trachomatis
DFYSC

SEQ ID NO: 5903 - protein, 5 aa, Chlamydia trachomatis
FYSCL

SEQ ID NO: 5904 - protein, 5 aa, Chlamydia trachomatis
YSCLQ

SEQ ID NO: 5905 - protein, 5 aa, Chlamydia trachomatis
SCLQG

SEQ ID NO: 5906 - protein, 5 aa, Chlamydia trachomatis
CLQGF

SEQ ID NO: 5907 - protein, 5 aa, Chlamydia trachomatis
LQGFR

SEQ ID NO: 5908 - protein, 5 aa, Chlamydia trachomatis
QGFRD

SEQ ID NO: 5909 - protein, 5 aa, Chlamydia trachomatis
GFRDN

SEQ ID NO: 5910 - protein, 5 aa, Chlamydia trachomatis
FRDNY

SEQ ID NO: 5911 - protein, 5 aa, Chlamydia trachomatis
RDNYK

SEQ ID NO: 5912 - protein, 5 aa, Chlamydia trachomatis
DNYKG

SEQ ID NO: 5913 - protein, 5 aa, Chlamydia trachomatis
NYKGF

SEQ ID NO: 5914 - protein, 5 aa, Chlamydia trachomatis
YKGFE

SEQ ID NO: 5915 - protein, 5 aa, Chlamydia trachomatis
KGFES

SEQ ID NO: 5916 - protein, 5 aa, Chlamydia trachomatis
GFESL

SEQ ID NO: 5917 - protein, 5 aa, Chlamydia trachomatis
FESLL

SEQ ID NO: 5918 - protein, 5 aa, Chlamydia trachomatis
ESLLD

SEQ ID NO: 5919 - protein, 5 aa, Chlamydia trachomatis
SLLDE

SEQ ID NO: 5920 - protein, 5 aa, Chlamydia trachomatis
LLDEY

SEQ ID NO: 5921 - protein, 5 aa, Chlamydia trachomatis
LDEYK

SEQ ID NO: 5922 - protein, 5 aa, Chlamydia trachomatis
DEYKN

SEQ ID NO: 5923 - protein, 5 aa, Chlamydia trachomatis
EYKNS

SEQ ID NO: 5924 - protein, 5 aa, Chlamydia trachomatis
YKNST

SEQ ID NO: 5925 - protein, 5 aa, Chlamydia trachomatis
KNSTE

SEQ ID NO: 5926 - protein, 5 aa, Chlamydia trachomatis
NSTEE

SEQ ID NO: 5927 - protein, 5 aa, Chlamydia trachomatis
STEEM

SEQ ID NO: 5928 - protein, 5 aa, Chlamydia trachomatis
TEEMR

SEQ ID NO: 5929 - protein, 5 aa, Chlamydia trachomatis
EEMRK

SEQ ID NO: 5930 - protein, 5 aa, Chlamydia trachomatis
EMRKL

SEQ ID NO: 5931 - protein, 5 aa, Chlamydia trachomatis
MRKLF

SEQ ID NO: 5932 - protein, 5 aa, Chlamydia trachomatis
RKLFS

SEQ ID NO: 5933 - protein, 5 aa, Chlamydia trachomatis
KLFSQ

SEQ ID NO: 5934 - protein, 5 aa, Chlamydia trachomatis
LFSQE

SEQ ID NO: 5935 - protein, 5 aa, Chlamydia trachomatis
FSQEI

SEQ ID NO: 5936 - protein, 5 aa, Chlamydia trachomatis
SQEII

SEQ ID NO: 5937 - protein, 5 aa, Chlamydia trachomatis
QEIIA

SEQ ID NO: 5938 - protein, 5 aa, Chlamydia trachomatis
EIIAD

SEQ ID NO: 5939 - protein, 5 aa, Chlamydia trachomatis
IIADL

SEQ ID NO: 5940 - protein, 5 aa, Chlamydia trachomatis
IADLK

SEQ ID NO: 5941 - protein, 5 aa, Chlamydia trachomatis
ADLKG

SEQ ID NO: 5942 - protein, 5 aa, Chlamydia trachomatis
DLKGS

SEQ ID NO: 5943 - protein, 5 aa, Chlamydia trachomatis
LKGSV

SEQ ID NO: 5944 - protein, 5 aa, Chlamydia trachomatis
KGSVA

SEQ ID NO: 5945 - protein, 5 aa, Chlamydia trachomatis
GSVAS

SEQ ID NO: 5946 - protein, 5 aa, Chlamydia trachomatis
SVASL

SEQ ID NO: 5947 - protein, 5 aa, Chlamydia trachomatis
VASLR

SEQ ID NO: 5948 - protein, 5 aa, Chlamydia trachomatis
ASLRE

SEQ ID NO: 5949 - protein, 5 aa, Chlamydia trachomatis
SLREE

SEQ ID NO: 5950 - protein, 5 aa, Chlamydia trachomatis
LREEI

SEQ ID NO: 5951 - protein, 5 aa, Chlamydia trachomatis
REEIR

SEQ ID NO: 5952 - protein, 5 aa, Chlamydia trachomatis
EEIRF

SEQ ID NO: 5953 - protein, 5 aa, Chlamydia trachomatis
EIRFL

SEQ ID NO: 5954 - protein, 5 aa, Chlamydia trachomatis
IRFLT

SEQ ID NO: 5955 - protein, 5 aa, Chlamydia trachomatis
RFLTP

SEQ ID NO: 5956 - protein, 5 aa, Chlamydia trachomatis
FLTPL

SEQ ID NO: 5957 - protein, 5 aa, Chlamydia trachomatis
LTPLA

SEQ ID NO: 5958 - protein, 5 aa, Chlamydia trachomatis
TPLAE

SEQ ID NO: 5959 - protein, 5 aa, Chlamydia trachomatis
PLAEE

SEQ ID NO: 5960 - protein, 5 aa, Chlamydia trachomatis
LAEEV

SEQ ID NO: 5961 - protein, 5 aa, Chlamydia trachomatis
AEEVR

SEQ ID NO: 5962 - protein, 5 aa, Chlamydia trachomatis
EEVRR

SEQ ID NO: 5963 - protein, 5 aa, Chlamydia trachomatis
EVRRL

SEQ ID NO: 5964 - protein, 5 aa, Chlamydia trachomatis
VRRLA

SEQ ID NO: 5965 - protein, 5 aa, Chlamydia trachomatis
RRLAH

SEQ ID NO: 5966 - protein, 5 aa, Chlamydia trachomatis
RLAHN

SEQ ID NO: 5967 - protein, 5 aa, Chlamydia trachomatis
LAHNQ

SEQ ID NO: 5968 - protein, 5 aa, Chlamydia trachomatis
AHNQQ

SEQ ID NO: 5969 - protein, 5 aa, Chlamydia trachomatis
HNQQS

SEQ ID NO: 5970 - protein, 5 aa, Chlamydia trachomatis
NQQSL

SEQ ID NO: 5971 - protein, 5 aa, Chlamydia trachomatis
QQSLT

SEQ ID NO: 5972 - protein, 5 aa, Chlamydia trachomatis
QSLTV

SEQ ID NO: 5973 - protein, 5 aa, Chlamydia trachomatis
SLTVV

SEQ ID NO: 5974 - protein, 5 aa, Chlamydia trachomatis
LTVVI

SEQ ID NO: 5975 - protein, 5 aa, Chlamydia trachomatis
TVVIE

SEQ ID NO: 5976 - protein, 5 aa, Chlamydia trachomatis
VVIEE

SEQ ID NO: 5977 - protein, 5 aa, Chlamydia trachomatis
VIEEL

SEQ ID NO: 5978 - protein, 5 aa, Chlamydia trachomatis
IEELK

SEQ ID NO: 5979 - protein, 5 aa, Chlamydia trachomatis
EELKT

SEQ ID NO: 5980 - protein, 5 aa, Chlamydia trachomatis
ELKTI

SEQ ID NO: 5981 - protein, 5 aa, Chlamydia trachomatis
LKTIR

SEQ ID NO: 5982 - protein, 5 aa, Chlamydia trachomatis
KTIRD

SEQ ID NO: 5983 - protein, 5 aa, Chlamydia trachomatis
TIRDS

SEQ ID NO: 5984 - protein, 5 aa, Chlamydia trachomatis
IRDSL

SEQ ID NO: 5985 - protein, 5 aa, Chlamydia trachomatis
RDSLR

SEQ ID NO: 5986 - protein, 5 aa, Chlamydia trachomatis
DSLRD

SEQ ID NO: 5987 - protein, 5 aa, Chlamydia trachomatis
SLRDE

SEQ ID NO: 5988 - protein, 5 aa, Chlamydia trachomatis
LRDEI

SEQ ID NO: 5989 - protein, 5 aa, Chlamydia trachomatis
RDEIG

SEQ ID NO: 5990 - protein, 5 aa, Chlamydia trachomatis
DEIGQ

SEQ ID NO: 5991 - protein, 5 aa, Chlamydia trachomatis
EIGQL

SEQ ID NO: 5992 - protein, 5 aa, Chlamydia trachomatis
IGQLS

SEQ ID NO: 5993 - protein, 5 aa, Chlamydia trachomatis
GQLSQ

SEQ ID NO: 5994 - protein, 5 aa, Chlamydia trachomatis
QLSQL

SEQ ID NO: 5995 - protein, 5 aa, Chlamydia trachomatis
LSQLS

SEQ ID NO: 5996 - protein, 5 aa, Chlamydia trachomatis
SQLSK

SEQ ID NO: 5997 - protein, 5 aa, Chlamydia trachomatis
QLSKT

SEQ ID NO: 5998 - protein, 5 aa, Chlamydia trachomatis
LSKTL

SEQ ID NO: 5999 - protein, 5 aa, Chlamydia trachomatis
SKTLT

SEQ ID NO: 6000 - protein, 5 aa, Chlamydia trachomatis
KTLTS

SEQ ID NO: 6001 - protein, 5 aa, Chlamydia trachomatis
TLTSQ

SEQ ID NO: 6002 - protein, 5 aa, Chlamydia trachomatis
LTSQI

SEQ ID NO: 6003 - protein, 5 aa, Chlamydia trachomatis
TSQIA

SEQ ID NO: 6004 - protein, 5 aa, Chlamydia trachomatis
SQIAL

SEQ ID NO: 6005 - protein, 5 aa, Chlamydia trachomatis
QIALQ

SEQ ID NO: 6006 - protein, 5 aa, Chlamydia trachomatis
IALQR

SEQ ID NO: 6007 - protein, 5 aa, Chlamydia trachomatis
ALQRK

SEQ ID NO: 6008 - protein, 5 aa, Chlamydia trachomatis
LQRKE

SEQ ID NO: 6009 - protein, 5 aa, Chlamydia trachomatis
QRKES

SEQ ID NO: 6010 - protein, 5 aa, Chlamydia trachomatis
RKESS

SEQ ID NO: 6011 - protein, 5 aa, Chlamydia trachomatis
KESSD

SEQ ID NO: 6012 - protein, 5 aa, Chlamydia trachomatis
ESSDL

SEQ ID NO: 6013 - protein, 5 aa, Chlamydia trachomatis
SSDLC

SEQ ID NO: 6014 - protein, 5 aa, Chlamydia trachomatis
SDLCS

SEQ ID NO: 6015 - protein, 5 aa, Chlamydia trachomatis
DLCSQ

SEQ ID NO: 6016 - protein, 5 aa, Chlamydia trachomatis
LCSQI

SEQ ID NO: 6017 - protein, 5 aa, Chlamydia trachomatis
CSQIR

SEQ ID NO: 6018 - protein, 5 aa, Chlamydia trachomatis
SQIRE

SEQ ID NO: 6019 - protein, 5 aa, Chlamydia trachomatis
QIRET

SEQ ID NO: 6020 - protein, 5 aa, Chlamydia trachomatis
IRETL

SEQ ID NO: 6021 - protein, 5 aa, Chlamydia trachomatis
RETLS

SEQ ID NO: 6022 - protein, 5 aa, Chlamydia trachomatis
ETLSS

SEQ ID NO: 6023 - protein, 5 aa, Chlamydia trachomatis
TLSSP

SEQ ID NO: 6024 - protein, 5 aa, Chlamydia trachomatis
LSSPR

SEQ ID NO: 6025 - protein, 5 aa, Chlamydia trachomatis
SSPRK

SEQ ID NO: 6026 - protein, 5 aa, Chlamydia trachomatis
SPRKS

SEQ ID NO: 6027 - protein, 5 aa, Chlamydia trachomatis
PRKSA

SEQ ID NO: 6028 - protein, 5 aa, Chlamydia trachomatis
RKSAS

SEQ ID NO: 6029 - protein, 5 aa, Chlamydia trachomatis
KSASP

SEQ ID NO: 6030 - protein, 5 aa, Chlamydia trachomatis
SASPS

SEQ ID NO: 6031 - protein, 5 aa, Chlamydia trachomatis
ASPST

SEQ ID NO: 6032 - protein, 5 aa, Chlamydia trachomatis
SPSTK

SEQ ID NO: 6033 - protein, 5 aa, Chlamydia trachomatis
PSTKS

SEQ ID NO: 6034 - protein, 5 aa, Chlamydia trachomatis
STKSS

SEQ ID NO: 6035 - protein, 5 aa, Chlamydia trachomatis
MTTLP

SEQ ID NO: 6036 - protein, 5 aa, Chlamydia trachomatis
TTLPN

SEQ ID NO: 6037 - protein, 5 aa, Chlamydia trachomatis
TLPNN

SEQ ID NO: 6038 - protein, 5 aa, Chlamydia trachomatis
LPNNC

SEQ ID NO: 6039 - protein, 5 aa, Chlamydia trachomatis
PNNCT

SEQ ID NO: 6040 - protein, 5 aa, Chlamydia trachomatis
NNCTS

SEQ ID NO: 6041 - protein, 5 aa, Chlamydia trachomatis
NCTSN

SEQ ID NO: 6042 - protein, 5 aa, Chlamydia trachomatis
CTSNS

SEQ ID NO: 6043 - protein, 5 aa, Chlamydia trachomatis
TSNSN

SEQ ID NO: 6044 - protein, 5 aa, Chlamydia trachomatis
SNSNS

SEQ ID NO: 6045 - protein, 5 aa, Chlamydia trachomatis
NSNSI

SEQ ID NO: 6046 - protein, 5 aa, Chlamydia trachomatis
SNSIN

SEQ ID NO: 6047 - protein, 5 aa, Chlamydia trachomatis
NSINT

SEQ ID NO: 6048 - protein, 5 aa, Chlamydia trachomatis
SINTF

SEQ ID NO: 6049 - protein, 5 aa, Chlamydia trachomatis
INTFT

SEQ ID NO: 6050 - protein, 5 aa, Chlamydia trachomatis
NTFTK

SEQ ID NO: 6051 - protein, 5 aa, Chlamydia trachomatis
TFTKD

SEQ ID NO: 6052 - protein, 5 aa, Chlamydia trachomatis
FTKDI

SEQ ID NO: 6053 - protein, 5 aa, Chlamydia trachomatis
TKDIE

SEQ ID NO: 6054 - protein, 5 aa, Chlamydia trachomatis
KDIEM

SEQ ID NO: 6055 - protein, 5 aa, Chlamydia trachomatis
DIEMA

SEQ ID NO: 6056 - protein, 5 aa, Chlamydia trachomatis
IEMAK

SEQ ID NO: 6057 - protein, 5 aa, Chlamydia trachomatis
EMAKQ

SEQ ID NO: 6058 - protein, 5 aa, Chlamydia trachomatis
MAKQI

SEQ ID NO: 6059 - protein, 5 aa, Chlamydia trachomatis
AKQIQ

SEQ ID NO: 6060 - protein, 5 aa, Chlamydia trachomatis
KQIQG

SEQ ID NO: 6061 - protein, 5 aa, Chlamydia trachomatis
QIQGS

SEQ ID NO: 6062 - protein, 5 aa, Chlamydia trachomatis
IQGSR

SEQ ID NO: 6063 - protein, 5 aa, Chlamydia trachomatis
QGSRK

SEQ ID NO: 6064 - protein, 5 aa, Chlamydia trachomatis
GSRKD

SEQ ID NO: 6065 - protein, 5 aa, Chlamydia trachomatis
SRKDP

SEQ ID NO: 6066 - protein, 5 aa, Chlamydia trachomatis
RKDPL

SEQ ID NO: 6067 - protein, 5 aa, Chlamydia trachomatis
KDPLA

SEQ ID NO: 6068 - protein, 5 aa, Chlamydia trachomatis
DPLAK

SEQ ID NO: 6069 - protein, 5 aa, Chlamydia trachomatis
PLAKT

SEQ ID NO: 6070 - protein, 5 aa, Chlamydia trachomatis
LAKTS

SEQ ID NO: 6071 - protein, 5 aa, Chlamydia trachomatis
AKTSW

SEQ ID NO: 6072 - protein, 5 aa, Chlamydia trachomatis
KTSWI

SEQ ID NO: 6073 - protein, 5 aa, Chlamydia trachomatis
TSWIA

SEQ ID NO: 6074 - protein, 5 aa, Chlamydia trachomatis
SWIAG

SEQ ID NO: 6075 - protein, 5 aa, Chlamydia trachomatis
WIAGL

SEQ ID NO: 6076 - protein, 5 aa, Chlamydia trachomatis
IAGLI

SEQ ID NO: 6077 - protein, 5 aa, Chlamydia trachomatis
AGLIC

SEQ ID NO: 6078 - protein, 5 aa, Chlamydia trachomatis
GLICV

SEQ ID NO: 6079 - protein, 5 aa, Chlamydia trachomatis
LICVV

SEQ ID NO: 6080 - protein, 5 aa, Chlamydia trachomatis
ICVVA

SEQ ID NO: 6081 - protein, 5 aa, Chlamydia trachomatis
CVVAG

SEQ ID NO: 6082 - protein, 5 aa, Chlamydia trachomatis
VVAGV

SEQ ID NO: 6083 - protein, 5 aa, Chlamydia trachomatis
VAGVL

SEQ ID NO: 6084 - protein, 5 aa, Chlamydia trachomatis
AGVLG

SEQ ID NO: 6085 - protein, 5 aa, Chlamydia trachomatis
GVLGL

SEQ ID NO: 6086 - protein, 5 aa, Chlamydia trachomatis
VLGLL

SEQ ID NO: 6087 - protein, 5 aa, Chlamydia trachomatis
LGLLA

SEQ ID NO: 6088 - protein, 5 aa, Chlamydia trachomatis
GLLAI

SEQ ID NO: 6089 - protein, 5 aa, Chlamydia trachomatis
LLAIG

SEQ ID NO: 6090 - protein, 5 aa, Chlamydia trachomatis
LAIGI

SEQ ID NO: 6091 - protein, 5 aa, Chlamydia trachomatis
AIGIG

SEQ ID NO: 6092 - protein, 5 aa, Chlamydia trachomatis
IGIGG

SEQ ID NO: 6093 - protein, 5 aa, Chlamydia trachomatis
GIGGC

SEQ ID NO: 6094 - protein, 5 aa, Chlamydia trachomatis
IGGCS

SEQ ID NO: 6095 - protein, 5 aa, Chlamydia trachomatis
GGCSM

SEQ ID NO: 6096 - protein, 5 aa, Chlamydia trachomatis
GCSMA

SEQ ID NO: 6097 - protein, 5 aa, Chlamydia trachomatis
CSMAS

SEQ ID NO: 6098 - protein, 5 aa, Chlamydia trachomatis
SMASG

SEQ ID NO: 6099 - protein, 5 aa, Chlamydia trachomatis
MASGL

SEQ ID NO: 6100 - protein, 5 aa, Chlamydia trachomatis
ASGLG

SEQ ID NO: 6101 - protein, 5 aa, Chlamydia trachomatis
SGLGL

SEQ ID NO: 6102 - protein, 5 aa, Chlamydia trachomatis
GLGLI

SEQ ID NO: 6103 - protein, 5 aa, Chlamydia trachomatis
LGLIG

SEQ ID NO: 6104 - protein, 5 aa, Chlamydia trachomatis
GLIGA

SEQ ID NO: 6105 - protein, 5 aa, Chlamydia trachomatis
LIGAI

SEQ ID NO: 6106 - protein, 5 aa, Chlamydia trachomatis
IGAIV

SEQ ID NO: 6107 - protein, 5 aa, Chlamydia trachomatis
GAIVA

SEQ ID NO: 6108 - protein, 5 aa, Chlamydia trachomatis
AIVAA

SEQ ID NO: 6109 - protein, 5 aa, Chlamydia trachomatis
IVAAV

SEQ ID NO: 6110 - protein, 5 aa, Chlamydia trachomatis
VAAVI

SEQ ID NO: 6111 - protein, 5 aa, Chlamydia trachomatis
AAVIV

SEQ ID NO: 6112 - protein, 5 aa, Chlamydia trachomatis
AVIVA

SEQ ID NO: 6113 - protein, 5 aa, Chlamydia trachomatis
VIVAV

SEQ ID NO: 6114 - protein, 5 aa, Chlamydia trachomatis
IVAVG

SEQ ID NO: 6115 - protein, 5 aa, Chlamydia trachomatis
VAVGL

SEQ ID NO: 6116 - protein, 5 aa, Chlamydia trachomatis
AVGLC

SEQ ID NO: 6117 - protein, 5 aa, Chlamydia trachomatis
VGLCC

SEQ ID NO: 6118 - protein, 5 aa, Chlamydia trachomatis
GLCCL

SEQ ID NO: 6119 - protein, 5 aa, Chlamydia trachomatis
LCCLV

SEQ ID NO: 6120 - protein, 5 aa, Chlamydia trachomatis
CCLVS

SEQ ID NO: 6121 - protein, 5 aa, Chlamydia trachomatis
CLVSA

SEQ ID NO: 6122 - protein, 5 aa, Chlamydia trachomatis
LVSAL

SEQ ID NO: 6123 - protein, 5 aa, Chlamydia trachomatis
VSALC

SEQ ID NO: 6124 - protein, 5 aa, Chlamydia trachomatis
SALCL

SEQ ID NO: 6125 - protein, 5 aa, Chlamydia trachomatis
ALCLQ

SEQ ID NO: 6126 - protein, 5 aa, Chlamydia trachomatis
LCLQV

SEQ ID NO: 6127 - protein, 5 aa, Chlamydia trachomatis
CLQVE

SEQ ID NO: 6128 - protein, 5 aa, Chlamydia trachomatis
LQVEK

SEQ ID NO: 6129 - protein, 5 aa, Chlamydia trachomatis
QVEKS

SEQ ID NO: 6130 - protein, 5 aa, Chlamydia trachomatis
VEKSQ

SEQ ID NO: 6131 - protein, 5 aa, Chlamydia trachomatis
EKSQW

SEQ ID NO: 6132 - protein, 5 aa, Chlamydia trachomatis
KSQWW

SEQ ID NO: 6133 - protein, 5 aa, Chlamydia trachomatis
SQWWQ

SEQ ID NO: 6134 - protein, 5 aa, Chlamydia trachomatis
QWWQK

SEQ ID NO: 6135 - protein, 5 aa, Chlamydia trachomatis
WWQKE

SEQ ID NO: 6136 - protein, 5 aa, Chlamydia trachomatis
WQKEF

SEQ ID NO: 6137 - protein, 5 aa, Chlamydia trachomatis
QKEFE

SEQ ID NO: 6138 - protein, 5 aa, Chlamydia trachomatis
KEFES

SEQ ID NO: 6139 - protein, 5 aa, Chlamydia trachomatis
EFESW

SEQ ID NO: 6140 - protein, 5 aa, Chlamydia trachomatis
FESWI

SEQ ID NO: 6141 - protein, 5 aa, Chlamydia trachomatis
ESWIE

SEQ ID NO: 6142 - protein, 5 aa, Chlamydia trachomatis
SWIEQ

SEQ ID NO: 6143 - protein, 5 aa, Chlamydia trachomatis
WIEQK

SEQ ID NO: 6144 - protein, 5 aa, Chlamydia trachomatis
IEQKS

SEQ ID NO: 6145 - protein, 5 aa, Chlamydia trachomatis
EQKSQ

SEQ ID NO: 6146 - protein, 5 aa, Chlamydia trachomatis
QKSQF

SEQ ID NO: 6147 - protein, 5 aa, Chlamydia trachomatis
KSQFR

SEQ ID NO: 6148 - protein, 5 aa, Chlamydia trachomatis
SQFRI

SEQ ID NO: 6149 - protein, 5 aa, Chlamydia trachomatis
QFRIV

SEQ ID NO: 6150 - protein, 5 aa, Chlamydia trachomatis
FRIVM

SEQ ID NO: 6151 - protein, 5 aa, Chlamydia trachomatis
RIVMA

SEQ ID NO: 6152 - protein, 5 aa, Chlamydia trachomatis
IVMAD

SEQ ID NO: 6153 - protein, 5 aa, Chlamydia trachomatis
VMADM

SEQ ID NO: 6154 - protein, 5 aa, Chlamydia trachomatis
MADML

SEQ ID NO: 6155 - protein, 5 aa, Chlamydia trachomatis
ADMLK

SEQ ID NO: 6156 - protein, 5 aa, Chlamydia trachomatis
DMLKA

SEQ ID NO: 6157 - protein, 5 aa, Chlamydia trachomatis
MLKAN

SEQ ID NO: 6158 - protein, 5 aa, Chlamydia trachomatis
LKANR

SEQ ID NO: 6159 - protein, 5 aa, Chlamydia trachomatis
KANRK

SEQ ID NO: 6160 - protein, 5 aa, Chlamydia trachomatis
ANRKL

SEQ ID NO: 6161 - protein, 5 aa, Chlamydia trachomatis
NRKLQ

SEQ ID NO: 6162 - protein, 5 aa, Chlamydia trachomatis
RKLQS

SEQ ID NO: 6163 - protein, 5 aa, Chlamydia trachomatis
KLQSE

SEQ ID NO: 6164 - protein, 5 aa, Chlamydia trachomatis
LQSEV

SEQ ID NO: 6165 - protein, 5 aa, Chlamydia trachomatis
QSEVE

SEQ ID NO: 6166 - protein, 5 aa, Chlamydia trachomatis
SEVEF

SEQ ID NO: 6167 - protein, 5 aa, Chlamydia trachomatis
EVEFL

SEQ ID NO: 6168 - protein, 5 aa, Chlamydia trachomatis
VEFLS

SEQ ID NO: 6169 - protein, 5 aa, Chlamydia trachomatis
EFLSK

SEQ ID NO: 6170 - protein, 5 aa, Chlamydia trachomatis
FLSKG

SEQ ID NO: 6171 - protein, 5 aa, Chlamydia trachomatis
LSKGW

SEQ ID NO: 6172 - protein, 5 aa, Chlamydia trachomatis
SKGWS

SEQ ID NO: 6173 - protein, 5 aa, Chlamydia trachomatis
KGWSD

SEQ ID NO: 6174 - protein, 5 aa, Chlamydia trachomatis
GWSDD

SEQ ID NO: 6175 - protein, 5 aa, Chlamydia trachomatis
WSDDT

SEQ ID NO: 6176 - protein, 5 aa, Chlamydia trachomatis
SDDTA

SEQ ID NO: 6177 - protein, 5 aa, Chlamydia trachomatis
DDTAV

SEQ ID NO: 6178 - protein, 5 aa, Chlamydia trachomatis
DTAVH

SEQ ID NO: 6179 - protein, 5 aa, Chlamydia trachomatis
TAVHK

SEQ ID NO: 6180 - protein, 5 aa, Chlamydia trachomatis
AVHKE

SEQ ID NO: 6181 - protein, 5 aa, Chlamydia trachomatis
VHKED

SEQ ID NO: 6182 - protein, 5 aa, Chlamydia trachomatis
HKEDV

SEQ ID NO: 6183 - protein, 5 aa, Chlamydia trachomatis
KEDVT

SEQ ID NO: 6184 - protein, 5 aa, Chlamydia trachomatis
EDVTK

SEQ ID NO: 6185 - protein, 5 aa, Chlamydia trachomatis
DVTKY

SEQ ID NO: 6186 - protein, 5 aa, Chlamydia trachomatis
VTKYE

SEQ ID NO: 6187 - protein, 5 aa, Chlamydia trachomatis
TKYEQ

SEQ ID NO: 6188 - protein, 5 aa, Chlamydia trachomatis
KYEQV

SEQ ID NO: 6189 - protein, 5 aa, Chlamydia trachomatis
YEQVV

SEQ ID NO: 6190 - protein, 5 aa, Chlamydia trachomatis
EQVVE

SEQ ID NO: 6191 - protein, 5 aa, Chlamydia trachomatis
QVVEE

SEQ ID NO: 6192 - protein, 5 aa, Chlamydia trachomatis
VVEEY

SEQ ID NO: 6193 - protein, 5 aa, Chlamydia trachomatis
VEEYA

SEQ ID NO: 6194 - protein, 5 aa, Chlamydia trachomatis
EEYAE

SEQ ID NO: 6195 - protein, 5 aa, Chlamydia trachomatis
EYAEK

SEQ ID NO: 6196 - protein, 5 aa, Chlamydia trachomatis
YAEKI

SEQ ID NO: 6197 - protein, 5 aa, Chlamydia trachomatis
AEKIM

SEQ ID NO: 6198 - protein, 5 aa, Chlamydia trachomatis
EKIME

SEQ ID NO: 6199 - protein, 5 aa, Chlamydia trachomatis
KIMEL

SEQ ID NO: 6200 - protein, 5 aa, Chlamydia trachomatis
IMELY

SEQ ID NO: 6201 - protein, 5 aa, Chlamydia trachomatis
MELYE

SEQ ID NO: 6202 - protein, 5 aa, Chlamydia trachomatis
ELYEE

SEQ ID NO: 6203 - protein, 5 aa, Chlamydia trachomatis
LYEET

SEQ ID NO: 6204 - protein, 5 aa, Chlamydia trachomatis
YEETG

SEQ ID NO: 6205 - protein, 5 aa, Chlamydia trachomatis
EETGV

SEQ ID NO: 6206 - protein, 5 aa, Chlamydia trachomatis
ETGVL

SEQ ID NO: 6207 - protein, 5 aa, Chlamydia trachomatis
TGVLT

SEQ ID NO: 6208 - protein, 5 aa, Chlamydia trachomatis
GVLTI

SEQ ID NO: 6209 - protein, 5 aa, Chlamydia trachomatis
VLTIE

SEQ ID NO: 6210 - protein, 5 aa, Chlamydia trachomatis
LTIEK

SEQ ID NO: 6211 - protein, 5 aa, Chlamydia trachomatis
TIEKI

SEQ ID NO: 6212 - protein, 5 aa, Chlamydia trachomatis
IEKIN

SEQ ID NO: 6213 - protein, 5 aa, Chlamydia trachomatis
EKINL

SEQ ID NO: 6214 - protein, 5 aa, Chlamydia trachomatis
KINLQ

SEQ ID NO: 6215 - protein, 5 aa, Chlamydia trachomatis
INLQK

SEQ ID NO: 6216 - protein, 5 aa, Chlamydia trachomatis
NLQKE

SEQ ID NO: 6217 - protein, 5 aa, Chlamydia trachomatis
LQKEK

SEQ ID NO: 6218 - protein, 5 aa, Chlamydia trachomatis
QKEKK

SEQ ID NO: 6219 - protein, 5 aa, Chlamydia trachomatis
KEKKA

SEQ ID NO: 6220 - protein, 5 aa, Chlamydia trachomatis
EKKAW

SEQ ID NO: 6221 - protein, 5 aa, Chlamydia trachomatis
KKAWL

SEQ ID NO: 6222 - protein, 5 aa, Chlamydia trachomatis
KAWLE

SEQ ID NO: 6223 - protein, 5 aa, Chlamydia trachomatis
AWLEE

SEQ ID NO: 6224 - protein, 5 aa, Chlamydia trachomatis
WLEEK

SEQ ID NO: 6225 - protein, 5 aa, Chlamydia trachomatis
LEEKA

SEQ ID NO: 6226 - protein, 5 aa, Chlamydia trachomatis
EEKAE

SEQ ID NO: 6227 - protein, 5 aa, Chlamydia trachomatis
EKAEM

SEQ ID NO: 6228 - protein, 5 aa, Chlamydia trachomatis
KAEME

SEQ ID NO: 6229 - protein, 5 aa, Chlamydia trachomatis
AEMEQ

SEQ ID NO: 6230 - protein, 5 aa, Chlamydia trachomatis
EMEQK

SEQ ID NO: 6231 - protein, 5 aa, Chlamydia trachomatis
MEQKL

SEQ ID NO: 6232 - protein, 5 aa, Chlamydia trachomatis
EQKLT

SEQ ID NO: 6233 - protein, 5 aa, Chlamydia trachomatis
QKLTT

SEQ ID NO: 6234 - protein, 5 aa, Chlamydia trachomatis
KLTTV

SEQ ID NO: 6235 - protein, 5 aa, Chlamydia trachomatis
LTTVT

SEQ ID NO: 6236 - protein, 5 aa, Chlamydia trachomatis
TTVTD

SEQ ID NO: 6237 - protein, 5 aa, Chlamydia trachomatis
TVTDL

SEQ ID NO: 6238 - protein, 5 aa, Chlamydia trachomatis
VTDLE

SEQ ID NO: 6239 - protein, 5 aa, Chlamydia trachomatis
TDLEA

SEQ ID NO: 6240 - protein, 5 aa, Chlamydia trachomatis
DLEAA

SEQ ID NO: 6241 - protein, 5 aa, Chlamydia trachomatis
LEAAK

SEQ ID NO: 6242 - protein, 5 aa, Chlamydia trachomatis
EAAKQ

SEQ ID NO: 6243 - protein, 5 aa, Chlamydia trachomatis
AAKQQ

SEQ ID NO: 6244 - protein, 5 aa, Chlamydia trachomatis
AKQQL

SEQ ID NO: 6245 - protein, 5 aa, Chlamydia trachomatis
KQQLE

SEQ ID NO: 6246 - protein, 5 aa, Chlamydia trachomatis
QQLEE

SEQ ID NO: 6247 - protein, 5 aa, Chlamydia trachomatis
QLEEK

SEQ ID NO: 6248 - protein, 5 aa, Chlamydia trachomatis
LEEKV

SEQ ID NO: 6249 - protein, 5 aa, Chlamydia trachomatis
EEKVT

SEQ ID NO: 6250 - protein, 5 aa, Chlamydia trachomatis
EKVTD

SEQ ID NO: 6251 - protein, 5 aa, Chlamydia trachomatis
KVTDL

SEQ ID NO: 6252 - protein, 5 aa, Chlamydia trachomatis
VTDLE

SEQ ID NO: 6253 - protein, 5 aa, Chlamydia trachomatis
TDLES

SEQ ID NO: 6254 - protein, 5 aa, Chlamydia trachomatis
DLESE

SEQ ID NO: 6255 - protein, 5 aa, Chlamydia trachomatis
LESEK

SEQ ID NO: 6256 - protein, 5 aa, Chlamydia trachomatis
ESEKQ

SEQ ID NO: 6257 - protein, 5 aa, Chlamydia trachomatis
SEKQE

SEQ ID NO: 6258 - protein, 5 aa, Chlamydia trachomatis
EKQEL

SEQ ID NO: 6259 - protein, 5 aa, Chlamydia trachomatis
KQELR

SEQ ID NO: 6260 - protein, 5 aa, Chlamydia trachomatis
QELRE

SEQ ID NO: 6261 - protein, 5 aa, Chlamydia trachomatis
ELREE

SEQ ID NO: 6262 - protein, 5 aa, Chlamydia trachomatis
LREEL

SEQ ID NO: 6263 - protein, 5 aa, Chlamydia trachomatis
REELD

SEQ ID NO: 6264 - protein, 5 aa, Chlamydia trachomatis
EELDK

SEQ ID NO: 6265 - protein, 5 aa, Chlamydia trachomatis
ELDKA

SEQ ID NO: 6266 - protein, 5 aa, Chlamydia trachomatis
LDKAI

SEQ ID NO: 6267 - protein, 5 aa, Chlamydia trachomatis
DKAIE

SEQ ID NO: 6268 - protein, 5 aa, Chlamydia trachomatis
KAIEN

SEQ ID NO: 6269 - protein, 5 aa, Chlamydia trachomatis
AIENL

SEQ ID NO: 6270 - protein, 5 aa, Chlamydia trachomatis
IENLD

SEQ ID NO: 6271 - protein, 5 aa, Chlamydia trachomatis
ENLDE

SEQ ID NO: 6272 - protein, 5 aa, Chlamydia trachomatis
NLDEM

SEQ ID NO: 6273 - protein, 5 aa, Chlamydia trachomatis
LDEMA

SEQ ID NO: 6274 - protein, 5 aa, Chlamydia trachomatis
DEMAY

SEQ ID NO: 6275 - protein, 5 aa, Chlamydia trachomatis
EMAYE

SEQ ID NO: 6276 - protein, 5 aa, Chlamydia trachomatis
MAYEA

SEQ ID NO: 6277 - protein, 5 aa, Chlamydia trachomatis
AYEAM

SEQ ID NO: 6278 - protein, 5 aa, Chlamydia trachomatis
YEAME

SEQ ID NO: 6279 - protein, 5 aa, Chlamydia trachomatis
EAMEF

SEQ ID NO: 6280 - protein, 5 aa, Chlamydia trachomatis
AMEFE

SEQ ID NO: 6281 - protein, 5 aa, Chlamydia trachomatis
MEFEK

SEQ ID NO: 6282 - protein, 5 aa, Chlamydia trachomatis
EFEKE

SEQ ID NO: 6283 - protein, 5 aa, Chlamydia trachomatis
FEKEK

SEQ ID NO: 6284 - protein, 5 aa, Chlamydia trachomatis
EKEKH

SEQ ID NO: 6285 - protein, 5 aa, Chlamydia trachomatis
KEKHG

SEQ ID NO: 6286 - protein, 5 aa, Chlamydia trachomatis
EKHGI

SEQ ID NO: 6287 - protein, 5 aa, Chlamydia trachomatis
KHGIK

SEQ ID NO: 6288 - protein, 5 aa, Chlamydia trachomatis
HGIKP

SEQ ID NO: 6289 - protein, 5 aa, Chlamydia trachomatis
GIKPG

SEQ ID NO: 6290 - protein, 5 aa, Chlamydia trachomatis
IKPGR

SEQ ID NO: 6291 - protein, 5 aa, Chlamydia trachomatis
KPGRR

SEQ ID NO: 6292 - protein, 5 aa, Chlamydia trachomatis
PGRRG

SEQ ID NO: 6293 - protein, 5 aa, Chlamydia trachomatis
GRRGS

SEQ ID NO: 6294 - protein, 5 aa, Chlamydia trachomatis
RRGSI

SEQ ID NO: 6295 - protein, 5 aa, Chlamydia trachomatis
MRFLL

SEQ ID NO: 6296 - protein, 5 aa, Chlamydia trachomatis
RFLLA

SEQ ID NO: 6297 - protein, 5 aa, Chlamydia trachomatis
FLLAL

SEQ ID NO: 6298 - protein, 5 aa, Chlamydia trachomatis
LLALF

SEQ ID NO: 6299 - protein, 5 aa, Chlamydia trachomatis
LALFS

SEQ ID NO: 6300 - protein, 5 aa, Chlamydia trachomatis
ALFSL

SEQ ID NO: 6301 - protein, 5 aa, Chlamydia trachomatis
LFSLI

SEQ ID NO: 6302 - protein, 5 aa, Chlamydia trachomatis
FSLIL

SEQ ID NO: 6303 - protein, 5 aa, Chlamydia trachomatis
SLILV

SEQ ID NO: 6304 - protein, 5 aa, Chlamydia trachomatis
LILVL

SEQ ID NO: 6305 - protein, 5 aa, Chlamydia trachomatis
ILVLP

SEQ ID NO: 6306 - protein, 5 aa, Chlamydia trachomatis
LVLPA

SEQ ID NO: 6307 - protein, 5 aa, Chlamydia trachomatis
VLPAT

SEQ ID NO: 6308 - protein, 5 aa, Chlamydia trachomatis
LPATE

SEQ ID NO: 6309 - protein, 5 aa, Chlamydia trachomatis
PATEA

SEQ ID NO: 6310 - protein, 5 aa, Chlamydia trachomatis
ATEAF

SEQ ID NO: 6311 - protein, 5 aa, Chlamydia trachomatis
TEAFS

SEQ ID NO: 6312 - protein, 5 aa, Chlamydia trachomatis
EAFST

SEQ ID NO: 6313 - protein, 5 aa, Chlamydia trachomatis
AFSTE

SEQ ID NO: 6314 - protein, 5 aa, Chlamydia trachomatis
FSTED

SEQ ID NO: 6315 - protein, 5 aa, Chlamydia trachomatis
STEDK

SEQ ID NO: 6316 - protein, 5 aa, Chlamydia trachomatis
TEDKQ

SEQ ID NO: 6317 - protein, 5 aa, Chlamydia trachomatis
EDKQC

SEQ ID NO: 6318 - protein, 5 aa, Chlamydia trachomatis
DKQCQ

SEQ ID NO: 6319 - protein, 5 aa, Chlamydia trachomatis
KQCQQ

SEQ ID NO: 6320 - protein, 5 aa, Chlamydia trachomatis
QCQQE

SEQ ID NO: 6321 - protein, 5 aa, Chlamydia trachomatis
CQQEA

SEQ ID NO: 6322 - protein, 5 aa, Chlamydia trachomatis
QQEAE

SEQ ID NO: 6323 - protein, 5 aa, Chlamydia trachomatis
QEAEE

SEQ ID NO: 6324 - protein, 5 aa, Chlamydia trachomatis
EAEED

SEQ ID NO: 6325 - protein, 5 aa, Chlamydia trachomatis
AEEDC

SEQ ID NO: 6326 - protein, 5 aa, Chlamydia trachomatis
EEDCS

SEQ ID NO: 6327 - protein, 5 aa, Chlamydia trachomatis
EDCSQ

SEQ ID NO: 6328 - protein, 5 aa, Chlamydia trachomatis
DCSQV

SEQ ID NO: 6329 - protein, 5 aa, Chlamydia trachomatis
CSQVA

SEQ ID NO: 6330 - protein, 5 aa, Chlamydia trachomatis
SQVAD

SEQ ID NO: 6331 - protein, 5 aa, Chlamydia trachomatis
QVADT

SEQ ID NO: 6332 - protein, 5 aa, Chlamydia trachomatis
VADTC

SEQ ID NO: 6333 - protein, 5 aa, Chlamydia trachomatis
ADTCV

SEQ ID NO: 6334 - protein, 5 aa, Chlamydia trachomatis
DTCVF

SEQ ID NO: 6335 - protein, 5 aa, Chlamydia trachomatis
TCVFY

SEQ ID NO: 6336 - protein, 5 aa, Chlamydia trachomatis
CVFYS

SEQ ID NO: 6337 - protein, 5 aa, Chlamydia trachomatis
VFYSY

SEQ ID NO: 6338 - protein, 5 aa, Chlamydia trachomatis
FYSYA

SEQ ID NO: 6339 - protein, 5 aa, Chlamydia trachomatis
YSYAE

SEQ ID NO: 6340 - protein, 5 aa, Chlamydia trachomatis
SYAEG

SEQ ID NO: 6341 - protein, 5 aa, Chlamydia trachomatis
YAEGL

SEQ ID NO: 6342 - protein, 5 aa, Chlamydia trachomatis
AEGLE

SEQ ID NO: 6343 - protein, 5 aa, Chlamydia trachomatis
EGLEH

SEQ ID NO: 6344 - protein, 5 aa, Chlamydia trachomatis
GLEHA

SEQ ID NO: 6345 - protein, 5 aa, Chlamydia trachomatis
LEHAR

SEQ ID NO: 6346 - protein, 5 aa, Chlamydia trachomatis
EHARD

SEQ ID NO: 6347 - protein, 5 aa, Chlamydia trachomatis
HARDE

SEQ ID NO: 6348 - protein, 5 aa, Chlamydia trachomatis
ARDEG

SEQ ID NO: 6349 - protein, 5 aa, Chlamydia trachomatis
RDEGK

SEQ ID NO: 6350 - protein, 5 aa, Chlamydia trachomatis
DEGKL

SEQ ID NO: 6351 - protein, 5 aa, Chlamydia trachomatis
EGKLT

SEQ ID NO: 6352 - protein, 5 aa, Chlamydia trachomatis
GKLTL

SEQ ID NO: 6353 - protein, 5 aa, Chlamydia trachomatis
KLTLV

SEQ ID NO: 6354 - protein, 5 aa, Chlamydia trachomatis
LTLVV

SEQ ID NO: 6355 - protein, 5 aa, Chlamydia trachomatis
TLVVL

SEQ ID NO: 6356 - protein, 5 aa, Chlamydia trachomatis
LVVLL

SEQ ID NO: 6357 - protein, 5 aa, Chlamydia trachomatis
VVLLD

SEQ ID NO: 6358 - protein, 5 aa, Chlamydia trachomatis
VLLDT

SEQ ID NO: 6359 - protein, 5 aa, Chlamydia trachomatis
LLDTS

SEQ ID NO: 6360 - protein, 5 aa, Chlamydia trachomatis
LDTSG

SEQ ID NO: 6361 - protein, 5 aa, Chlamydia trachomatis
DTSGY

SEQ ID NO: 6362 - protein, 5 aa, Chlamydia trachomatis
TSGYS

SEQ ID NO: 6363 - protein, 5 aa, Chlamydia trachomatis
SGYSF

SEQ ID NO: 6364 - protein, 5 aa, Chlamydia trachomatis
GYSFE

SEQ ID NO: 6365 - protein, 5 aa, Chlamydia trachomatis
YSFET

SEQ ID NO: 6366 - protein, 5 aa, Chlamydia trachomatis
SFETL

SEQ ID NO: 6367 - protein, 5 aa, Chlamydia trachomatis
FETLA

SEQ ID NO: 6368 - protein, 5 aa, Chlamydia trachomatis
ETLAD

SEQ ID NO: 6369 - protein, 5 aa, Chlamydia trachomatis
TLADA

SEQ ID NO: 6370 - protein, 5 aa, Chlamydia trachomatis
LADAA

SEQ ID NO: 6371 - protein, 5 aa, Chlamydia trachomatis
ADAAH

SEQ ID NO: 6372 - protein, 5 aa, Chlamydia trachomatis
DAAHA

SEQ ID NO: 6373 - protein, 5 aa, Chlamydia trachomatis
AAHAM

SEQ ID NO: 6374 - protein, 5 aa, Chlamydia trachomatis
AHAME

SEQ ID NO: 6375 - protein, 5 aa, Chlamydia trachomatis
HAMES

SEQ ID NO: 6376 - protein, 5 aa, Chlamydia trachomatis
AMESS

SEQ ID NO: 6377 - protein, 5 aa, Chlamydia trachomatis
MESSL

SEQ ID NO: 6378 - protein, 5 aa, Chlamydia trachomatis
ESSLL

SEQ ID NO: 6379 - protein, 5 aa, Chlamydia trachomatis
SSLLS

SEQ ID NO: 6380 - protein, 5 aa, Chlamydia trachomatis
SLLST

SEQ ID NO: 6381 - protein, 5 aa, Chlamydia trachomatis
LLSTF

SEQ ID NO: 6382 - protein, 5 aa, Chlamydia trachomatis
LSTFA

SEQ ID NO: 6383 - protein, 5 aa, Chlamydia trachomatis
STFAD

SEQ ID NO: 6384 - protein, 5 aa, Chlamydia trachomatis
TFADF

SEQ ID NO: 6385 - protein, 5 aa, Chlamydia trachomatis
FADFV

SEQ ID NO: 6386 - protein, 5 aa, Chlamydia trachomatis
ADFVV

SEQ ID NO: 6387 - protein, 5 aa, Chlamydia trachomatis
DFVVL

SEQ ID NO: 6388 - protein, 5 aa, Chlamydia trachomatis
FVVLS

SEQ ID NO: 6389 - protein, 5 aa, Chlamydia trachomatis
VVLSR

SEQ ID NO: 6390 - protein, 5 aa, Chlamydia trachomatis
VLSRR

SEQ ID NO: 6391 - protein, 5 aa, Chlamydia trachomatis
LSRRE

SEQ ID NO: 6392 - protein, 5 aa, Chlamydia trachomatis
SRREA

SEQ ID NO: 6393 - protein, 5 aa, Chlamydia trachomatis
RREAV

SEQ ID NO: 6394 - protein, 5 aa, Chlamydia trachomatis
REAVP

SEQ ID NO: 6395 - protein, 5 aa, Chlamydia trachomatis
EAVPL

SEQ ID NO: 6396 - protein, 5 aa, Chlamydia trachomatis
AVPLI

SEQ ID NO: 6397 - protein, 5 aa, Chlamydia trachomatis
VPLIY

SEQ ID NO: 6398 - protein, 5 aa, Chlamydia trachomatis
PLIYP

SEQ ID NO: 6399 - protein, 5 aa, Chlamydia trachomatis
LIYPP

SEQ ID NO: 6400 - protein, 5 aa, Chlamydia trachomatis
IYPPV

SEQ ID NO: 6401 - protein, 5 aa, Chlamydia trachomatis
YPPVP

SEQ ID NO: 6402 - protein, 5 aa, Chlamydia trachomatis
PPVPD

SEQ ID NO: 6403 - protein, 5 aa, Chlamydia trachomatis
PVPDP

SEQ ID NO: 6404 - protein, 5 aa, Chlamydia trachomatis
VPDPM

SEQ ID NO: 6405 - protein, 5 aa, Chlamydia trachomatis
PDPMV

SEQ ID NO: 6406 - protein, 5 aa, Chlamydia trachomatis
DPMVG

SEQ ID NO: 6407 - protein, 5 aa, Chlamydia trachomatis
PMVGE

SEQ ID NO: 6408 - protein, 5 aa, Chlamydia trachomatis
MVGEI

SEQ ID NO: 6409 - protein, 5 aa, Chlamydia trachomatis
VGEIA

SEQ ID NO: 6410 - protein, 5 aa, Chlamydia trachomatis
GEIAL

SEQ ID NO: 6411 - protein, 5 aa, Chlamydia trachomatis
EIALF

SEQ ID NO: 6412 - protein, 5 aa, Chlamydia trachomatis
IALFL

SEQ ID NO: 6413 - protein, 5 aa, Chlamydia trachomatis
ALFLE

SEQ ID NO: 6414 - protein, 5 aa, Chlamydia trachomatis
LFLEA

SEQ ID NO: 6415 - protein, 5 aa, Chlamydia trachomatis
FLEAF

SEQ ID NO: 6416 - protein, 5 aa, Chlamydia trachomatis
LEAFS

SEQ ID NO: 6417 - protein, 5 aa, Chlamydia trachomatis
EAFSD

SEQ ID NO: 6418 - protein, 5 aa, Chlamydia trachomatis
AFSDQ

SEQ ID NO: 6419 - protein, 5 aa, Chlamydia trachomatis
FSDQT

SEQ ID NO: 6420 - protein, 5 aa, Chlamydia trachomatis
SDQTF

SEQ ID NO: 6421 - protein, 5 aa, Chlamydia trachomatis
DQTFP

SEQ ID NO: 6422 - protein, 5 aa, Chlamydia trachomatis
QTFPS

SEQ ID NO: 6423 - protein, 5 aa, Chlamydia trachomatis
TFPSQ

SEQ ID NO: 6424 - protein, 5 aa, Chlamydia trachomatis
FPSQP

SEQ ID NO: 6425 - protein, 5 aa, Chlamydia trachomatis
PSQPV

SEQ ID NO: 6426 - protein, 5 aa, Chlamydia trachomatis
SQPVI

SEQ ID NO: 6427 - protein, 5 aa, Chlamydia trachomatis
QPVIV

SEQ ID NO: 6428 - protein, 5 aa, Chlamydia trachomatis
PVIVT

SEQ ID NO: 6429 - protein, 5 aa, Chlamydia trachomatis
VIVTL

SEQ ID NO: 6430 - protein, 5 aa, Chlamydia trachomatis
IVTLA

SEQ ID NO: 6431 - protein, 5 aa, Chlamydia trachomatis
VTLAI

SEQ ID NO: 6432 - protein, 5 aa, Chlamydia trachomatis
TLAIG

SEQ ID NO: 6433 - protein, 5 aa, Chlamydia trachomatis
LAIGA

SEQ ID NO: 6434 - protein, 5 aa, Chlamydia trachomatis
AIGAS

SEQ ID NO: 6435 - protein, 5 aa, Chlamydia trachomatis
IGASS

SEQ ID NO: 6436 - protein, 5 aa, Chlamydia trachomatis
GASSA

SEQ ID NO: 6437 - protein, 5 aa, Chlamydia trachomatis
ASSAE

SEQ ID NO: 6438 - protein, 5 aa, Chlamydia trachomatis
SSAEI

SEQ ID NO: 6439 - protein, 5 aa, Chlamydia trachomatis
SAEIM

SEQ ID NO: 6440 - protein, 5 aa, Chlamydia trachomatis
AEIMD

SEQ ID NO: 6441 - protein, 5 aa, Chlamydia trachomatis
EIMDI

SEQ ID NO: 6442 - protein, 5 aa, Chlamydia trachomatis
IMDIT

SEQ ID NO: 6443 - protein, 5 aa, Chlamydia trachomatis
MDITE

SEQ ID NO: 6444 - protein, 5 aa, Chlamydia trachomatis
DITEI

SEQ ID NO: 6445 - protein, 5 aa, Chlamydia trachomatis
ITEIP

SEQ ID NO: 6446 - protein, 5 aa, Chlamydia trachomatis
TEIPS

SEQ ID NO: 6447 - protein, 5 aa, Chlamydia trachomatis
EIPSI

SEQ ID NO: 6448 - protein, 5 aa, Chlamydia trachomatis
IPSIN

SEQ ID NO: 6449 - protein, 5 aa, Chlamydia trachomatis
PSINP

SEQ ID NO: 6450 - protein, 5 aa, Chlamydia trachomatis
SINPE

SEQ ID NO: 6451 - protein, 5 aa, Chlamydia trachomatis
INPEF

SEQ ID NO: 6452 - protein, 5 aa, Chlamydia trachomatis
NPEFV

SEQ ID NO: 6453 - protein, 5 aa, Chlamydia trachomatis
PEFVE

SEQ ID NO: 6454 - protein, 5 aa, Chlamydia trachomatis
MNRIH

SEQ ID NO: 6455 - protein, 5 aa, Chlamydia trachomatis
NRIHR

SEQ ID NO: 6456 - protein, 5 aa, Chlamydia trachomatis
RIHRT

SEQ ID NO: 6457 - protein, 5 aa, Chlamydia trachomatis
IHRTQ

SEQ ID NO: 6458 - protein, 5 aa, Chlamydia trachomatis
HRTQG

SEQ ID NO: 6459 - protein, 5 aa, Chlamydia trachomatis
RTQGS

SEQ ID NO: 6460 - protein, 5 aa, Chlamydia trachomatis
TQGSL

SEQ ID NO: 6461 - protein, 5 aa, Chlamydia trachomatis
QGSLT

SEQ ID NO: 6462 - protein, 5 aa, Chlamydia trachomatis
GSLTD

SEQ ID NO: 6463 - protein, 5 aa, Chlamydia trachomatis
SLTDY

SEQ ID NO: 6464 - protein, 5 aa, Chlamydia trachomatis
LTDYN

SEQ ID NO: 6465 - protein, 5 aa, Chlamydia trachomatis
TDYNS

SEQ ID NO: 6466 - protein, 5 aa, Chlamydia trachomatis
DYNST

SEQ ID NO: 6467 - protein, 5 aa, Chlamydia trachomatis
YNSTL

SEQ ID NO: 6468 - protein, 5 aa, Chlamydia trachomatis
NSTLE

SEQ ID NO: 6469 - protein, 5 aa, Chlamydia trachomatis
STLEA

SEQ ID NO: 6470 - protein, 5 aa, Chlamydia trachomatis
TLEAI

SEQ ID NO: 6471 - protein, 5 aa, Chlamydia trachomatis
LEAIA

SEQ ID NO: 6472 - protein, 5 aa, Chlamydia trachomatis
EAIAK

SEQ ID NO: 6473 - protein, 5 aa, Chlamydia trachomatis
AIAKK

SEQ ID NO: 6474 - protein, 5 aa, Chlamydia trachomatis
IAKKI

SEQ ID NO: 6475 - protein, 5 aa, Chlamydia trachomatis
AKKIA

SEQ ID NO: 6476 - protein, 5 aa, Chlamydia trachomatis
KKIAK

SEQ ID NO: 6477 - protein, 5 aa, Chlamydia trachomatis
KIAKP

SEQ ID NO: 6478 - protein, 5 aa, Chlamydia trachomatis
IAKPD

SEQ ID NO: 6479 - protein, 5 aa, Chlamydia trachomatis
AKPDS

SEQ ID NO: 6480 - protein, 5 aa, Chlamydia trachomatis
KPDSA

SEQ ID NO: 6481 - protein, 5 aa, Chlamydia trachomatis
PDSAT

SEQ ID NO: 6482 - protein, 5 aa, Chlamydia trachomatis
DSATI

SEQ ID NO: 6483 - protein, 5 aa, Chlamydia trachomatis
SATIV

SEQ ID NO: 6484 - protein, 5 aa, Chlamydia trachomatis
ATIVS

SEQ ID NO: 6485 - protein, 5 aa, Chlamydia trachomatis
TIVSQ

SEQ ID NO: 6486 - protein, 5 aa, Chlamydia trachomatis
IVSQV

SEQ ID NO: 6487 - protein, 5 aa, Chlamydia trachomatis
VSQVA

SEQ ID NO: 6488 - protein, 5 aa, Chlamydia trachomatis
SQVAQ

SEQ ID NO: 6489 - protein, 5 aa, Chlamydia trachomatis
QVAQY

SEQ ID NO: 6490 - protein, 5 aa, Chlamydia trachomatis
VAQYE

SEQ ID NO: 6491 - protein, 5 aa, Chlamydia trachomatis
AQYEQ

SEQ ID NO: 6492 - protein, 5 aa, Chlamydia trachomatis
QYEQF

SEQ ID NO: 6493 - protein, 5 aa, Chlamydia trachomatis
YEQFK

SEQ ID NO: 6494 - protein, 5 aa, Chlamydia trachomatis
EQFKM

SEQ ID NO: 6495 - protein, 5 aa, Chlamydia trachomatis
QFKME

SEQ ID NO: 6496 - protein, 5 aa, Chlamydia trachomatis
FKMEQ

SEQ ID NO: 6497 - protein, 5 aa, Chlamydia trachomatis
KMEQE

SEQ ID NO: 6498 - protein, 5 aa, Chlamydia trachomatis
MEQEA

SEQ ID NO: 6499 - protein, 5 aa, Chlamydia trachomatis
EQEAL

SEQ ID NO: 6500 - protein, 5 aa, Chlamydia trachomatis
QEALK

SEQ ID NO: 6501 - protein, 5 aa, Chlamydia trachomatis
EALKA

SEQ ID NO: 6502 - protein, 5 aa, Chlamydia trachomatis
ALKAL

SEQ ID NO: 6503 - protein, 5 aa, Chlamydia trachomatis
LKALL

SEQ ID NO: 6504 - protein, 5 aa, Chlamydia trachomatis
KALLV

SEQ ID NO: 6505 - protein, 5 aa, Chlamydia trachomatis
ALLVS

SEQ ID NO: 6506 - protein, 5 aa, Chlamydia trachomatis
LLVSF

SEQ ID NO: 6507 - protein, 5 aa, Chlamydia trachomatis
LVSFD

SEQ ID NO: 6508 - protein, 5 aa, Chlamydia trachomatis
VSFDQ

SEQ ID NO: 6509 - protein, 5 aa, Chlamydia trachomatis
SFDQK

SEQ ID NO: 6510 - protein, 5 aa, Chlamydia trachomatis
FDQKA

SEQ ID NO: 6511 - protein, 5 aa, Chlamydia trachomatis
DQKAD

SEQ ID NO: 6512 - protein, 5 aa, Chlamydia trachomatis
QKADQ

SEQ ID NO: 6513 - protein, 5 aa, Chlamydia trachomatis
KADQR

SEQ ID NO: 6514 - protein, 5 aa, Chlamydia trachomatis
ADQRY

SEQ ID NO: 6515 - protein, 5 aa, Chlamydia trachomatis
DQRYR

SEQ ID NO: 6516 - protein, 5 aa, Chlamydia trachomatis
QRYRN

SEQ ID NO: 6517 - protein, 5 aa, Chlamydia trachomatis
RYRNL

SEQ ID NO: 6518 - protein, 5 aa, Chlamydia trachomatis
YRNLI

SEQ ID NO: 6519 - protein, 5 aa, Chlamydia trachomatis
RNLIQ

SEQ ID NO: 6520 - protein, 5 aa, Chlamydia trachomatis
NLIQR

SEQ ID NO: 6521 - protein, 5 aa, Chlamydia trachomatis
LIQRL

SEQ ID NO: 6522 - protein, 5 aa, Chlamydia trachomatis
IQRLE

SEQ ID NO: 6523 - protein, 5 aa, Chlamydia trachomatis
QRLEQ

SEQ ID NO: 6524 - protein, 5 aa, Chlamydia trachomatis
RLEQL

SEQ ID NO: 6525 - protein, 5 aa, Chlamydia trachomatis
LEQLD

SEQ ID NO: 6526 - protein, 5 aa, Chlamydia trachomatis
EQLDV

SEQ ID NO: 6527 - protein, 5 aa, Chlamydia trachomatis
QLDVD

SEQ ID NO: 6528 - protein, 5 aa, Chlamydia trachomatis
LDVDR

SEQ ID NO: 6529 - protein, 5 aa, Chlamydia trachomatis
DVDRQ

SEQ ID NO: 6530 - protein, 5 aa, Chlamydia trachomatis
VDRQT

SEQ ID NO: 6531 - protein, 5 aa, Chlamydia trachomatis
DRQTG

SEQ ID NO: 6532 - protein, 5 aa, Chlamydia trachomatis
RQTGR

SEQ ID NO: 6533 - protein, 5 aa, Chlamydia trachomatis
QTGRS

SEQ ID NO: 6534 - protein, 5 aa, Chlamydia trachomatis
TGRST

SEQ ID NO: 6535 - protein, 5 aa, Chlamydia trachomatis
GRSTE

SEQ ID NO: 6536 - protein, 5 aa, Chlamydia trachomatis
RSTES

SEQ ID NO: 6537 - protein, 5 aa, Chlamydia trachomatis
STESQ

SEQ ID NO: 6538 - protein, 5 aa, Chlamydia trachomatis
TESQH

SEQ ID NO: 6539 - protein, 5 aa, Chlamydia trachomatis
ESQHI

SEQ ID NO: 6540 - protein, 5 aa, Chlamydia trachomatis
SQHIQ

SEQ ID NO: 6541 - protein, 5 aa, Chlamydia trachomatis
QHIQE

SEQ ID NO: 6542 - protein, 5 aa, Chlamydia trachomatis
HIQEK

SEQ ID NO: 6543 - protein, 5 aa, Chlamydia trachomatis
IQEKP

SEQ ID NO: 6544 - protein, 5 aa, Chlamydia trachomatis
QEKPM

SEQ ID NO: 6545 - protein, 5 aa, Chlamydia trachomatis
EKPMA

SEQ ID NO: 6546 - protein, 5 aa, Chlamydia trachomatis
KPMAS

SEQ ID NO: 6547 - protein, 5 aa, Chlamydia trachomatis
PMASL

SEQ ID NO: 6548 - protein, 5 aa, Chlamydia trachomatis
MASLQ

SEQ ID NO: 6549 - protein, 5 aa, Chlamydia trachomatis
ASLQS

SEQ ID NO: 6550 - protein, 5 aa, Chlamydia trachomatis
SLQSE

SEQ ID NO: 6551 - protein, 5 aa, Chlamydia trachomatis
LQSEN

SEQ ID NO: 6552 - protein, 5 aa, Chlamydia trachomatis
QSENQ

SEQ ID NO: 6553 - protein, 5 aa, Chlamydia trachomatis
SENQV

SEQ ID NO: 6554 - protein, 5 aa, Chlamydia trachomatis
ENQVV

SEQ ID NO: 6555 - protein, 5 aa, Chlamydia trachomatis
NQVVA

SEQ ID NO: 6556 - protein, 5 aa, Chlamydia trachomatis
QVVAQ

SEQ ID NO: 6557 - protein, 5 aa, Chlamydia trachomatis
VVAQA

SEQ ID NO: 6558 - protein, 5 aa, Chlamydia trachomatis
VAQAV

SEQ ID NO: 6559 - protein, 5 aa, Chlamydia trachomatis
AQAVV

SEQ ID NO: 6560 - protein, 5 aa, Chlamydia trachomatis
QAVVQ

SEQ ID NO: 6561 - protein, 5 aa, Chlamydia trachomatis
AVVQS

SEQ ID NO: 6562 - protein, 5 aa, Chlamydia trachomatis
VVQSD

SEQ ID NO: 6563 - protein, 5 aa, Chlamydia trachomatis
VQSDS

SEQ ID NO: 6564 - protein, 5 aa, Chlamydia trachomatis
QSDSS

SEQ ID NO: 6565 - protein, 5 aa, Chlamydia trachomatis
SDSSM

SEQ ID NO: 6566 - protein, 5 aa, Chlamydia trachomatis
DSSMP

SEQ ID NO: 6567 - protein, 5 aa, Chlamydia trachomatis
SSMPI

SEQ ID NO: 6568 - protein, 5 aa, Chlamydia trachomatis
SMPIF

SEQ ID NO: 6569 - protein, 5 aa, Chlamydia trachomatis
MPIFT

SEQ ID NO: 6570 - protein, 5 aa, Chlamydia trachomatis
PIFTG

SEQ ID NO: 6571 - protein, 5 aa, Chlamydia trachomatis
IFTGI

SEQ ID NO: 6572 - protein, 5 aa, Chlamydia trachomatis
FTGIK

SEQ ID NO: 6573 - protein, 5 aa, Chlamydia trachomatis
TGIKQ

SEQ ID NO: 6574 - protein, 5 aa, Chlamydia trachomatis
GIKQS

SEQ ID NO: 6575 - protein, 5 aa, Chlamydia trachomatis
IKQSW

SEQ ID NO: 6576 - protein, 5 aa, Chlamydia trachomatis
KQSWA

SEQ ID NO: 6577 - protein, 5 aa, Chlamydia trachomatis
QSWAV

SEQ ID NO: 6578 - protein, 5 aa, Chlamydia trachomatis
SWAVR

SEQ ID NO: 6579 - protein, 5 aa, Chlamydia trachomatis
WAVRL

SEQ ID NO: 6580 - protein, 5 aa, Chlamydia trachomatis
AVRLV

SEQ ID NO: 6581 - protein, 5 aa, Chlamydia trachomatis
VRLVQ

SEQ ID NO: 6582 - protein, 5 aa, Chlamydia trachomatis
RLVQG

SEQ ID NO: 6583 - protein, 5 aa, Chlamydia trachomatis
LVQGI

SEQ ID NO: 6584 - protein, 5 aa, Chlamydia trachomatis
VQGIR

SEQ ID NO: 6585 - protein, 5 aa, Chlamydia trachomatis
QGIRE

SEQ ID NO: 6586 - protein, 5 aa, Chlamydia trachomatis
GIREI

SEQ ID NO: 6587 - protein, 5 aa, Chlamydia trachomatis
IREIL

SEQ ID NO: 6588 - protein, 5 aa, Chlamydia trachomatis
REILD

SEQ ID NO: 6589 - protein, 5 aa, Chlamydia trachomatis
EILDQ

SEQ ID NO: 6590 - protein, 5 aa, Chlamydia trachomatis
ILDQV

SEQ ID NO: 6591 - protein, 5 aa, Chlamydia trachomatis
LDQVL

SEQ ID NO: 6592 - protein, 5 aa, Chlamydia trachomatis
DQVLV

SEQ ID NO: 6593 - protein, 5 aa, Chlamydia trachomatis
QVLVD

SEQ ID NO: 6594 - protein, 5 aa, Chlamydia trachomatis
VLVDT

SEQ ID NO: 6595 - protein, 5 aa, Chlamydia trachomatis
LVDTS

SEQ ID NO: 6596 - protein, 5 aa, Chlamydia trachomatis
VDTSL

SEQ ID NO: 6597 - protein, 5 aa, Chlamydia trachomatis
DTSLF

SEQ ID NO: 6598 - protein, 5 aa, Chlamydia trachomatis
TSLFT

SEQ ID NO: 6599 - protein, 5 aa, Chlamydia trachomatis
SLFTE

SEQ ID NO: 6600 - protein, 5 aa, Chlamydia trachomatis
LFTEE

SEQ ID NO: 6601 - protein, 5 aa, Chlamydia trachomatis
FTEEE

SEQ ID NO: 6602 - protein, 5 aa, Chlamydia trachomatis
TEEER

SEQ ID NO: 6603 - protein, 5 aa, Chlamydia trachomatis
EEERG

SEQ ID NO: 6604 - protein, 5 aa, Chlamydia trachomatis
EERGD

SEQ ID NO: 6605 - protein, 5 aa, Chlamydia trachomatis
ERGDL

SEQ ID NO: 6606 - protein, 5 aa, Chlamydia trachomatis
RGDLL

SEQ ID NO: 6607 - protein, 5 aa, Chlamydia trachomatis
GDLLA

SEQ ID NO: 6608 - protein, 5 aa, Chlamydia trachomatis
DLLAI

SEQ ID NO: 6609 - protein, 5 aa, Chlamydia trachomatis
LLAIR

SEQ ID NO: 6610 - protein, 5 aa, Chlamydia trachomatis
LAIRM

SEQ ID NO: 6611 - protein, 5 aa, Chlamydia trachomatis
AIRMD

SEQ ID NO: 6612 - protein, 5 aa, Chlamydia trachomatis
IRMDA

SEQ ID NO: 6613 - protein, 5 aa, Chlamydia trachomatis
RMDAA

SEQ ID NO: 6614 - protein, 5 aa, Chlamydia trachomatis
MDAAS

SEQ ID NO: 6615 - protein, 5 aa, Chlamydia trachomatis
DAASL

SEQ ID NO: 6616 - protein, 5 aa, Chlamydia trachomatis
AASLQ

SEQ ID NO: 6617 - protein, 5 aa, Chlamydia trachomatis
ASLQD

SEQ ID NO: 6618 - protein, 5 aa, Chlamydia trachomatis
SLQDK

SEQ ID NO: 6619 - protein, 5 aa, Chlamydia trachomatis
LQDKQ

SEQ ID NO: 6620 - protein, 5 aa, Chlamydia trachomatis
QDKQE

SEQ ID NO: 6621 - protein, 5 aa, Chlamydia trachomatis
DKQER

SEQ ID NO: 6622 - protein, 5 aa, Chlamydia trachomatis
KQERL

SEQ ID NO: 6623 - protein, 5 aa, Chlamydia trachomatis
QERLS

SEQ ID NO: 6624 - protein, 5 aa, Chlamydia trachomatis
ERLST

SEQ ID NO: 6625 - protein, 5 aa, Chlamydia trachomatis
RLSTE

SEQ ID NO: 6626 - protein, 5 aa, Chlamydia trachomatis
LSTED

SEQ ID NO: 6627 - protein, 5 aa, Chlamydia trachomatis
STEDI

SEQ ID NO: 6628 - protein, 5 aa, Chlamydia trachomatis
TEDIR

SEQ ID NO: 6629 - protein, 5 aa, Chlamydia trachomatis
EDIRS

SEQ ID NO: 6630 - protein, 5 aa, Chlamydia trachomatis
DIRSL

SEQ ID NO: 6631 - protein, 5 aa, Chlamydia trachomatis
IRSLL

SEQ ID NO: 6632 - protein, 5 aa, Chlamydia trachomatis
RSLLS

SEQ ID NO: 6633 - protein, 5 aa, Chlamydia trachomatis
SLLSL

SEQ ID NO: 6634 - protein, 5 aa, Chlamydia trachomatis
LLSLS

SEQ ID NO: 6635 - protein, 5 aa, Chlamydia trachomatis
LSLSN

SEQ ID NO: 6636 - protein, 5 aa, Chlamydia trachomatis
SLSND

SEQ ID NO: 6637 - protein, 5 aa, Chlamydia trachomatis
LSNDV

SEQ ID NO: 6638 - protein, 5 aa, Chlamydia trachomatis
SNDVM

SEQ ID NO: 6639 - protein, 5 aa, Chlamydia trachomatis
NDVMR

SEQ ID NO: 6640 - protein, 5 aa, Chlamydia trachomatis
DVMRV

SEQ ID NO: 6641 - protein, 5 aa, Chlamydia trachomatis
VMRVL

SEQ ID NO: 6642 - protein, 5 aa, Chlamydia trachomatis
MRVLQ

SEQ ID NO: 6643 - protein, 5 aa, Chlamydia trachomatis
RVLQK

SEQ ID NO: 6644 - protein, 5 aa, Chlamydia trachomatis
VLQKA

SEQ ID NO: 6645 - protein, 5 aa, Chlamydia trachomatis
LQKAS

SEQ ID NO: 6646 - protein, 5 aa, Chlamydia trachomatis
QKASV

SEQ ID NO: 6647 - protein, 5 aa, Chlamydia trachomatis
KASVS

SEQ ID NO: 6648 - protein, 5 aa, Chlamydia trachomatis
ASVSS

SEQ ID NO: 6649 - protein, 5 aa, Chlamydia trachomatis
SVSST

SEQ ID NO: 6650 - protein, 5 aa, Chlamydia trachomatis
VSSTR

SEQ ID NO: 6651 - protein, 5 aa, Chlamydia trachomatis
SSTRQ

SEQ ID NO: 6652 - protein, 5 aa, Chlamydia trachomatis
STRQL

SEQ ID NO: 6653 - protein, 5 aa, Chlamydia trachomatis
TRQLE

SEQ ID NO: 6654 - protein, 5 aa, Chlamydia trachomatis
RQLEL

SEQ ID NO: 6655 - protein, 5 aa, Chlamydia trachomatis
QLELI

SEQ ID NO: 6656 - protein, 5 aa, Chlamydia trachomatis
LELIQ

SEQ ID NO: 6657 - protein, 5 aa, Chlamydia trachomatis
ELIQS

SEQ ID NO: 6658 - protein, 5 aa, Chlamydia trachomatis
LIQSL

SEQ ID NO: 6659 - protein, 5 aa, Chlamydia trachomatis
IQSLI

SEQ ID NO: 6660 - protein, 5 aa, Chlamydia trachomatis
QSLID

SEQ ID NO: 6661 - protein, 5 aa, Chlamydia trachomatis
SLIDI

SEQ ID NO: 6662 - protein, 5 aa, Chlamydia trachomatis
LIDIF

SEQ ID NO: 6663 - protein, 5 aa, Chlamydia trachomatis
IDIFG

SEQ ID NO: 6664 - protein, 5 aa, Chlamydia trachomatis
DIFGT

SEQ ID NO: 6665 - protein, 5 aa, Chlamydia trachomatis
IFGTE

SEQ ID NO: 6666 - protein, 5 aa, Chlamydia trachomatis
FGTEE

SEQ ID NO: 6667 - protein, 5 aa, Chlamydia trachomatis
GTEEN

SEQ ID NO: 6668 - protein, 5 aa, Chlamydia trachomatis
TEENL

SEQ ID NO: 6669 - protein, 5 aa, Chlamydia trachomatis
EENLE

SEQ ID NO: 6670 - protein, 5 aa, Chlamydia trachomatis
ENLEQ

SEQ ID NO: 6671 - protein, 5 aa, Chlamydia trachomatis
NLEQS

SEQ ID NO: 6672 - protein, 5 aa, Chlamydia trachomatis
LEQSF

SEQ ID NO: 6673 - protein, 5 aa, Chlamydia trachomatis
EQSFA

SEQ ID NO: 6674 - protein, 5 aa, Chlamydia trachomatis
QSFAQ

SEQ ID NO: 6675 - protein, 5 aa, Chlamydia trachomatis
SFAQV

SEQ ID NO: 6676 - protein, 5 aa, Chlamydia trachomatis
FAQVR

SEQ ID NO: 6677 - protein, 5 aa, Chlamydia trachomatis
AQVRL

SEQ ID NO: 6678 - protein, 5 aa, Chlamydia trachomatis
QVRLE

SEQ ID NO: 6679 - protein, 5 aa, Chlamydia trachomatis
VRLEN

SEQ ID NO: 6680 - protein, 5 aa, Chlamydia trachomatis
RLENF

SEQ ID NO: 6681 - protein, 5 aa, Chlamydia trachomatis
LENFQ

SEQ ID NO: 6682 - protein, 5 aa, Chlamydia trachomatis
ENFQA

SEQ ID NO: 6683 - protein, 5 aa, Chlamydia trachomatis
NFQAI

SEQ ID NO: 6684 - protein, 5 aa, Chlamydia trachomatis
FQAIL

SEQ ID NO: 6685 - protein, 5 aa, Chlamydia trachomatis
QAILS

SEQ ID NO: 6686 - protein, 5 aa, Chlamydia trachomatis
AILSV

SEQ ID NO: 6687 - protein, 5 aa, Chlamydia trachomatis
ILSVI

SEQ ID NO: 6688 - protein, 5 aa, Chlamydia trachomatis
LSVIK

SEQ ID NO: 6689 - protein, 5 aa, Chlamydia trachomatis
SVIKE

SEQ ID NO: 6690 - protein, 5 aa, Chlamydia trachomatis
VIKER

SEQ ID NO: 6691 - protein, 5 aa, Chlamydia trachomatis
IKERL

SEQ ID NO: 6692 - protein, 5 aa, Chlamydia trachomatis
KERLT

SEQ ID NO: 6693 - protein, 5 aa, Chlamydia trachomatis
ERLTE

SEQ ID NO: 6694 - protein, 5 aa, Chlamydia trachomatis
RLTEE

SEQ ID NO: 6695 - protein, 5 aa, Chlamydia trachomatis
LTEEE

SEQ ID NO: 6696 - protein, 5 aa, Chlamydia trachomatis
TEEEF

SEQ ID NO: 6697 - protein, 5 aa, Chlamydia trachomatis
EEEFR

SEQ ID NO: 6698 - protein, 5 aa, Chlamydia trachomatis
EEFRV

SEQ ID NO: 6699 - protein, 5 aa, Chlamydia trachomatis
EFRVF

SEQ ID NO: 6700 - protein, 5 aa, Chlamydia trachomatis
FRVFQ

SEQ ID NO: 6701 - protein, 5 aa, Chlamydia trachomatis
RVFQE

SEQ ID NO: 6702 - protein, 5 aa, Chlamydia trachomatis
VFQEV

SEQ ID NO: 6703 - protein, 5 aa, Chlamydia trachomatis
FQEVS

SEQ ID NO: 6704 - protein, 5 aa, Chlamydia trachomatis
QEVSE

SEQ ID NO: 6705 - protein, 5 aa, Chlamydia trachomatis
EVSEE

SEQ ID NO: 6706 - protein, 5 aa, Chlamydia trachomatis
VSEEI

SEQ ID NO: 6707 - protein, 5 aa, Chlamydia trachomatis
SEEIS

SEQ ID NO: 6708 - protein, 5 aa, Chlamydia trachomatis
EEISS

SEQ ID NO: 6709 - protein, 5 aa, Chlamydia trachomatis
EISSI

SEQ ID NO: 6710 - protein, 5 aa, Chlamydia trachomatis
ISSIQ

SEQ ID NO: 6711 - protein, 5 aa, Chlamydia trachomatis
SSIQR

SEQ ID NO: 6712 - protein, 5 aa, Chlamydia trachomatis
SIQRT

SEQ ID NO: 6713 - protein, 5 aa, Chlamydia trachomatis
IQRTS

SEQ ID NO: 6714 - protein, 5 aa, Chlamydia trachomatis
QRTSE

SEQ ID NO: 6715 - protein, 5 aa, Chlamydia trachomatis
RTSES

SEQ ID NO: 6716 - protein, 5 aa, Chlamydia trachomatis
TSESH

SEQ ID NO: 6717 - protein, 5 aa, Chlamydia trachomatis
SESHL

SEQ ID NO: 6718 - protein, 5 aa, Chlamydia trachomatis
ESHLS

SEQ ID NO: 6719 - protein, 5 aa, Chlamydia trachomatis
SHLSP

SEQ ID NO: 6720 - protein, 5 aa, Chlamydia trachomatis
HLSPE

SEQ ID NO: 6721 - protein, 5 aa, Chlamydia trachomatis
LSPEH

SEQ ID NO: 6722 - protein, 5 aa, Chlamydia trachomatis
SPEHI

SEQ ID NO: 6723 - protein, 5 aa, Chlamydia trachomatis
PEHIE

SEQ ID NO: 6724 - protein, 5 aa, Chlamydia trachomatis
EHIEA

SEQ ID NO: 6725 - protein, 5 aa, Chlamydia trachomatis
HIEAI

SEQ ID NO: 6726 - protein, 5 aa, Chlamydia trachomatis
IEAIA

SEQ ID NO: 6727 - protein, 5 aa, Chlamydia trachomatis
EAIAR

SEQ ID NO: 6728 - protein, 5 aa, Chlamydia trachomatis
AIARV

SEQ ID NO: 6729 - protein, 5 aa, Chlamydia trachomatis
IARVG

SEQ ID NO: 6730 - protein, 5 aa, Chlamydia trachomatis
ARVGG

SEQ ID NO: 6731 - protein, 5 aa, Chlamydia trachomatis
RVGGH

SEQ ID NO: 6732 - protein, 5 aa, Chlamydia trachomatis
VGGHL

SEQ ID NO: 6733 - protein, 5 aa, Chlamydia trachomatis
GGHLS

SEQ ID NO: 6734 - protein, 5 aa, Chlamydia trachomatis
GHLSA

SEQ ID NO: 6735 - protein, 5 aa, Chlamydia trachomatis
HLSAK

SEQ ID NO: 6736 - protein, 5 aa, Chlamydia trachomatis
LSAKI

SEQ ID NO: 6737 - protein, 5 aa, Chlamydia trachomatis
SAKIV

SEQ ID NO: 6738 - protein, 5 aa, Chlamydia trachomatis
AKIVE

SEQ ID NO: 6739 - protein, 5 aa, Chlamydia trachomatis
KIVES

SEQ ID NO: 6740 - protein, 5 aa, Chlamydia trachomatis
IVESE

SEQ ID NO: 6741 - protein, 5 aa, Chlamydia trachomatis
VESEL

SEQ ID NO: 6742 - protein, 5 aa, Chlamydia trachomatis
ESELK

SEQ ID NO: 6743 - protein, 5 aa, Chlamydia trachomatis
SELKA

SEQ ID NO: 6744 - protein, 5 aa, Chlamydia trachomatis
ELKAS

SEQ ID NO: 6745 - protein, 5 aa, Chlamydia trachomatis
LKASQ

SEQ ID NO: 6746 - protein, 5 aa, Chlamydia trachomatis
KASQK

SEQ ID NO: 6747 - protein, 5 aa, Chlamydia trachomatis
ASQKV

SEQ ID NO: 6748 - protein, 5 aa, Chlamydia trachomatis
SQKVD

SEQ ID NO: 6749 - protein, 5 aa, Chlamydia trachomatis
QKVDL

SEQ ID NO: 6750 - protein, 5 aa, Chlamydia trachomatis
KVDLC

SEQ ID NO: 6751 - protein, 5 aa, Chlamydia trachomatis
VDLCQ

SEQ ID NO: 6752 - protein, 5 aa, Chlamydia trachomatis
DLCQR

SEQ ID NO: 6753 - protein, 5 aa, Chlamydia trachomatis
LCQRI

SEQ ID NO: 6754 - protein, 5 aa, Chlamydia trachomatis
CQRIA

SEQ ID NO: 6755 - protein, 5 aa, Chlamydia trachomatis
QRIAA

SEQ ID NO: 6756 - protein, 5 aa, Chlamydia trachomatis
RIAAM

SEQ ID NO: 6757 - protein, 5 aa, Chlamydia trachomatis
IAAMY

SEQ ID NO: 6758 - protein, 5 aa, Chlamydia trachomatis
AAMYQ

SEQ ID NO: 6759 - protein, 5 aa, Chlamydia trachomatis
AMYQE

SEQ ID NO: 6760 - protein, 5 aa, Chlamydia trachomatis
MYQEQ

SEQ ID NO: 6761 - protein, 5 aa, Chlamydia trachomatis
YQEQV

SEQ ID NO: 6762 - protein, 5 aa, Chlamydia trachomatis
QEQVD

SEQ ID NO: 6763 - protein, 5 aa, Chlamydia trachomatis
EQVDA

SEQ ID NO: 6764 - protein, 5 aa, Chlamydia trachomatis
QVDAV

SEQ ID NO: 6765 - protein, 5 aa, Chlamydia trachomatis
VDAVQ

SEQ ID NO: 6766 - protein, 5 aa, Chlamydia trachomatis
DAVQA

SEQ ID NO: 6767 - protein, 5 aa, Chlamydia trachomatis
AVQAY

SEQ ID NO: 6768 - protein, 5 aa, Chlamydia trachomatis
VQAYH

SEQ ID NO: 6769 - protein, 5 aa, Chlamydia trachomatis
QAYHS

SEQ ID NO: 6770 - protein, 5 aa, Chlamydia trachomatis
AYHSL

SEQ ID NO: 6771 - protein, 5 aa, Chlamydia trachomatis
YHSLE

SEQ ID NO: 6772 - protein, 5 aa, Chlamydia trachomatis
HSLEQ

SEQ ID NO: 6773 - protein, 5 aa, Chlamydia trachomatis
SLEQD

SEQ ID NO: 6774 - protein, 5 aa, Chlamydia trachomatis
LEQDA

SEQ ID NO: 6775 - protein, 5 aa, Chlamydia trachomatis
EQDAL

SEQ ID NO: 6776 - protein, 5 aa, Chlamydia trachomatis
QDALF

SEQ ID NO: 6777 - protein, 5 aa, Chlamydia trachomatis
DALFV

SEQ ID NO: 6778 - protein, 5 aa, Chlamydia trachomatis
ALFVN

SEQ ID NO: 6779 - protein, 5 aa, Chlamydia trachomatis
LFVNS

SEQ ID NO: 6780 - protein, 5 aa, Chlamydia trachomatis
FVNSR

SEQ ID NO: 6781 - protein, 5 aa, Chlamydia trachomatis
VNSRQ

SEQ ID NO: 6782 - protein, 5 aa, Chlamydia trachomatis
NSRQH

SEQ ID NO: 6783 - protein, 5 aa, Chlamydia trachomatis
SRQHS

SEQ ID NO: 6784 - protein, 5 aa, Chlamydia trachomatis
RQHSH

SEQ ID NO: 6785 - protein, 5 aa, Chlamydia trachomatis
QHSHF

SEQ ID NO: 6786 - protein, 5 aa, Chlamydia trachomatis
HSHFV

SEQ ID NO: 6787 - protein, 5 aa, Chlamydia trachomatis
SHFVQ

SEQ ID NO: 6788 - protein, 5 aa, Chlamydia trachomatis
HFVQV

SEQ ID NO: 6789 - protein, 5 aa, Chlamydia trachomatis
FVQVI

SEQ ID NO: 6790 - protein, 5 aa, Chlamydia trachomatis
VQVIS

SEQ ID NO: 6791 - protein, 5 aa, Chlamydia trachomatis
QVISL

SEQ ID NO: 6792 - protein, 5 aa, Chlamydia trachomatis
VISLV

SEQ ID NO: 6793 - protein, 5 aa, Chlamydia trachomatis
ISLVS

SEQ ID NO: 6794 - protein, 5 aa, Chlamydia trachomatis
SLVSS

SEQ ID NO: 6795 - protein, 5 aa, Chlamydia trachomatis
LVSSL

SEQ ID NO: 6796 - protein, 5 aa, Chlamydia trachomatis
VSSLM

SEQ ID NO: 6797 - protein, 5 aa, Chlamydia trachomatis
SSLMH

SEQ ID NO: 6798 - protein, 5 aa, Chlamydia trachomatis
SLMHS

SEQ ID NO: 6799 - protein, 5 aa, Chlamydia trachomatis
LMHSL

SEQ ID NO: 6800 - protein, 5 aa, Chlamydia trachomatis
MHSLS

SEQ ID NO: 6801 - protein, 5 aa, Chlamydia trachomatis
HSLSP

SEQ ID NO: 6802 - protein, 5 aa, Chlamydia trachomatis
SLSPT

SEQ ID NO: 6803 - protein, 5 aa, Chlamydia trachomatis
LSPTS

SEQ ID NO: 6804 - protein, 5 aa, Chlamydia trachomatis
SPTSE

SEQ ID NO: 6805 - protein, 5 aa, Chlamydia trachomatis
PTSEE

SEQ ID NO: 6806 - protein, 5 aa, Chlamydia trachomatis
TSEEE

SEQ ID NO: 6807 - protein, 5 aa, Chlamydia trachomatis
SEEER

SEQ ID NO: 6808 - protein, 5 aa, Chlamydia trachomatis
EEERI

SEQ ID NO: 6809 - protein, 5 aa, Chlamydia trachomatis
EERIL

SEQ ID NO: 6810 - protein, 5 aa, Chlamydia trachomatis
ERILL

SEQ ID NO: 6811 - protein, 5 aa, Chlamydia trachomatis
RILLN

SEQ ID NO: 6812 - protein, 5 aa, Chlamydia trachomatis
ILLNP

SEQ ID NO: 6813 - protein, 5 aa, Chlamydia trachomatis
LLNPA

SEQ ID NO: 6814 - protein, 5 aa, Chlamydia trachomatis
LNPAM

SEQ ID NO: 6815 - protein, 5 aa, Chlamydia trachomatis
NPAMM

SEQ ID NO: 6816 - protein, 5 aa, Chlamydia trachomatis
PAMMV

SEQ ID NO: 6817 - protein, 5 aa, Chlamydia trachomatis
AMMVS

SEQ ID NO: 6818 - protein, 5 aa, Chlamydia trachomatis
MMVSV

SEQ ID NO: 6819 - protein, 5 aa, Chlamydia trachomatis
MVSVL

SEQ ID NO: 6820 - protein, 5 aa, Chlamydia trachomatis
VSVLP

SEQ ID NO: 6821 - protein, 5 aa, Chlamydia trachomatis
SVLPT

SEQ ID NO: 6822 - protein, 5 aa, Chlamydia trachomatis
VLPTV

SEQ ID NO: 6823 - protein, 5 aa, Chlamydia trachomatis
LPTVR

SEQ ID NO: 6824 - protein, 5 aa, Chlamydia trachomatis
PTVRA

SEQ ID NO: 6825 - protein, 5 aa, Chlamydia trachomatis
TVRAI

SEQ ID NO: 6826 - protein, 5 aa, Chlamydia trachomatis
VRAIG

SEQ ID NO: 6827 - protein, 5 aa, Chlamydia trachomatis
RAIGL

SEQ ID NO: 6828 - protein, 5 aa, Chlamydia trachomatis
AIGLR

SEQ ID NO: 6829 - protein, 5 aa, Chlamydia trachomatis
IGLRF

SEQ ID NO: 6830 - protein, 5 aa, Chlamydia trachomatis
GLRFD

SEQ ID NO: 6831 - protein, 5 aa, Chlamydia trachomatis
LRFDF

SEQ ID NO: 6832 - protein, 5 aa, Chlamydia trachomatis
RFDFL

SEQ ID NO: 6833 - protein, 5 aa, Chlamydia trachomatis
FDFLT

SEQ ID NO: 6834 - protein, 5 aa, Chlamydia trachomatis
DFLTA

SEQ ID NO: 6835 - protein, 5 aa, Chlamydia trachomatis
FLTAE

SEQ ID NO: 6836 - protein, 5 aa, Chlamydia trachomatis
LTAEQ

SEQ ID NO: 6837 - protein, 5 aa, Chlamydia trachomatis
TAEQQ

SEQ ID NO: 6838 - protein, 5 aa, Chlamydia trachomatis
AEQQQ

SEQ ID NO: 6839 - protein, 5 aa, Chlamydia trachomatis
EQQQM

SEQ ID NO: 6840 - protein, 5 aa, Chlamydia trachomatis
QQQMV

SEQ ID NO: 6841 - protein, 5 aa, Chlamydia trachomatis
QQMVN

SEQ ID NO: 6842 - protein, 5 aa, Chlamydia trachomatis
QMVNA

SEQ ID NO: 6843 - protein, 5 aa, Chlamydia trachomatis
MVNAA

SEQ ID NO: 6844 - protein, 5 aa, Chlamydia trachomatis
VNAAV

SEQ ID NO: 6845 - protein, 5 aa, Chlamydia trachomatis
NAAVS

SEQ ID NO: 6846 - protein, 5 aa, Chlamydia trachomatis
AAVSS

SEQ ID NO: 6847 - protein, 5 aa, Chlamydia trachomatis
AVSSL

SEQ ID NO: 6848 - protein, 5 aa, Chlamydia trachomatis
VSSLQ

SEQ ID NO: 6849 - protein, 5 aa, Chlamydia trachomatis
SSLQQ

SEQ ID NO: 6850 - protein, 5 aa, Chlamydia trachomatis
SLQQQ

SEQ ID NO: 6851 - protein, 5 aa, Chlamydia trachomatis
LQQQQ

SEQ ID NO: 6852 - protein, 5 aa, Chlamydia trachomatis
QQQQL

SEQ ID NO: 6853 - protein, 5 aa, Chlamydia trachomatis
QQQLD

SEQ ID NO: 6854 - protein, 5 aa, Chlamydia trachomatis
QQLDE

SEQ ID NO: 6855 - protein, 5 aa, Chlamydia trachomatis
QLDEF

SEQ ID NO: 6856 - protein, 5 aa, Chlamydia trachomatis
LDEFL

SEQ ID NO: 6857 - protein, 5 aa, Chlamydia trachomatis
DEFLG

SEQ ID NO: 6858 - protein, 5 aa, Chlamydia trachomatis
EFLGV

SEQ ID NO: 6859 - protein, 5 aa, Chlamydia trachomatis
FLGVL

SEQ ID NO: 6860 - protein, 5 aa, Chlamydia trachomatis
LGVLC

SEQ ID NO: 6861 - protein, 5 aa, Chlamydia trachomatis
GVLCA

SEQ ID NO: 6862 - protein, 5 aa, Chlamydia trachomatis
VLCAH

SEQ ID NO: 6863 - protein, 5 aa, Chlamydia trachomatis
LCAHL

SEQ ID NO: 6864 - protein, 5 aa, Chlamydia trachomatis
CAHLV

SEQ ID NO: 6865 - protein, 5 aa, Chlamydia trachomatis
AHLVV

SEQ ID NO: 6866 - protein, 5 aa, Chlamydia trachomatis
HLVVV

SEQ ID NO: 6867 - protein, 5 aa, Chlamydia trachomatis
LVVVN

SEQ ID NO: 6868 - protein, 5 aa, Chlamydia trachomatis
VVVNC

SEQ ID NO: 6869 - protein, 5 aa, Chlamydia trachomatis
VVNCQ

SEQ ID NO: 6870 - protein, 5 aa, Chlamydia trachomatis
VNCQN

SEQ ID NO: 6871 - protein, 5 aa, Chlamydia trachomatis
NCQNK

SEQ ID NO: 6872 - protein, 5 aa, Chlamydia trachomatis
CQNKE

SEQ ID NO: 6873 - protein, 5 aa, Chlamydia trachomatis
QNKET

SEQ ID NO: 6874 - protein, 5 aa, Chlamydia trachomatis
NKETG

SEQ ID NO: 6875 - protein, 5 aa, Chlamydia trachomatis
KETGL

SEQ ID NO: 6876 - protein, 5 aa, Chlamydia trachomatis
ETGLL

SEQ ID NO: 6877 - protein, 5 aa, Chlamydia trachomatis
TGLLE

SEQ ID NO: 6878 - protein, 5 aa, Chlamydia trachomatis
GLLEG

SEQ ID NO: 6879 - protein, 5 aa, Chlamydia trachomatis
LLEGL

SEQ ID NO: 6880 - protein, 5 aa, Chlamydia trachomatis
LEGLE

SEQ ID NO: 6881 - protein, 5 aa, Chlamydia trachomatis
EGLEE

SEQ ID NO: 6882 - protein, 5 aa, Chlamydia trachomatis
GLEES

SEQ ID NO: 6883 - protein, 5 aa, Chlamydia trachomatis
LEESF

SEQ ID NO: 6884 - protein, 5 aa, Chlamydia trachomatis
EESFS

SEQ ID NO: 6885 - protein, 5 aa, Chlamydia trachomatis
ESFSE

SEQ ID NO: 6886 - protein, 5 aa, Chlamydia trachomatis
SFSET

SEQ ID NO: 6887 - protein, 5 aa, Chlamydia trachomatis
FSETL

SEQ ID NO: 6888 - protein, 5 aa, Chlamydia trachomatis
SETLS

SEQ ID NO: 6889 - protein, 5 aa, Chlamydia trachomatis
ETLSG

SEQ ID NO: 6890 - protein, 5 aa, Chlamydia trachomatis
TLSGL

SEQ ID NO: 6891 - protein, 5 aa, Chlamydia trachomatis
LSGLS

SEQ ID NO: 6892 - protein, 5 aa, Chlamydia trachomatis
SGLSN

SEQ ID NO: 6893 - protein, 5 aa, Chlamydia trachomatis
GLSNN

SEQ ID NO: 6894 - protein, 5 aa, Chlamydia trachomatis
LSNNF

SEQ ID NO: 6895 - protein, 5 aa, Chlamydia trachomatis
SNNFV

SEQ ID NO: 6896 - protein, 5 aa, Chlamydia trachomatis
NNFVL

SEQ ID NO: 6897 - protein, 5 aa, Chlamydia trachomatis
NFVLT

SEQ ID NO: 6898 - protein, 5 aa, Chlamydia trachomatis
FVLTA

SEQ ID NO: 6899 - protein, 5 aa, Chlamydia trachomatis
VLTAK

SEQ ID NO: 6900 - protein, 5 aa, Chlamydia trachomatis
LTAKM

SEQ ID NO: 6901 - protein, 5 aa, Chlamydia trachomatis
TAKMQ

SEQ ID NO: 6902 - protein, 5 aa, Chlamydia trachomatis
AKMQD

SEQ ID NO: 6903 - protein, 5 aa, Chlamydia trachomatis
KMQDI

SEQ ID NO: 6904 - protein, 5 aa, Chlamydia trachomatis
MQDIL

SEQ ID NO: 6905 - protein, 5 aa, Chlamydia trachomatis
QDILQ

SEQ ID NO: 6906 - protein, 5 aa, Chlamydia trachomatis
DILQV

SEQ ID NO: 6907 - protein, 5 aa, Chlamydia trachomatis
ILQVC

SEQ ID NO: 6908 - protein, 5 aa, Chlamydia trachomatis
LQVCS

SEQ ID NO: 6909 - protein, 5 aa, Chlamydia trachomatis
QVCSL

SEQ ID NO: 6910 - protein, 5 aa, Chlamydia trachomatis
VCSLQ

SEQ ID NO: 6911 - protein, 5 aa, Chlamydia trachomatis
CSLQG

SEQ ID NO: 6912 - protein, 5 aa, Chlamydia trachomatis
SLQGF

SEQ ID NO: 6913 - protein, 5 aa, Chlamydia trachomatis
LQGFV

SEQ ID NO: 6914 - protein, 5 aa, Chlamydia trachomatis
QGFVT

SEQ ID NO: 6915 - protein, 5 aa, Chlamydia trachomatis
GFVTL

SEQ ID NO: 6916 - protein, 5 aa, Chlamydia trachomatis
FVTLA

SEQ ID NO: 6917 - protein, 5 aa, Chlamydia trachomatis
VTLAN

SEQ ID NO: 6918 - protein, 5 aa, Chlamydia trachomatis
TLANG

SEQ ID NO: 6919 - protein, 5 aa, Chlamydia trachomatis
LANGD

SEQ ID NO: 6920 - protein, 5 aa, Chlamydia trachomatis
ANGDR

SEQ ID NO: 6921 - protein, 5 aa, Chlamydia trachomatis
NGDRY

SEQ ID NO: 6922 - protein, 5 aa, Chlamydia trachomatis
GDRYE

SEQ ID NO: 6923 - protein, 5 aa, Chlamydia trachomatis
DRYEL

SEQ ID NO: 6924 - protein, 5 aa, Chlamydia trachomatis
RYELF

SEQ ID NO: 6925 - protein, 5 aa, Chlamydia trachomatis
YELFS

SEQ ID NO: 6926 - protein, 5 aa, Chlamydia trachomatis
ELFSY

SEQ ID NO: 6927 - protein, 5 aa, Chlamydia trachomatis
LFSYN

SEQ ID NO: 6928 - protein, 5 aa, Chlamydia trachomatis
FSYND

SEQ ID NO: 6929 - protein, 5 aa, Chlamydia trachomatis
SYNDS

SEQ ID NO: 6930 - protein, 5 aa, Chlamydia trachomatis
YNDSG

SEQ ID NO: 6931 - protein, 5 aa, Chlamydia trachomatis
NDSGE

SEQ ID NO: 6932 - protein, 5 aa, Chlamydia trachomatis
DSGEA

SEQ ID NO: 6933 - protein, 5 aa, Chlamydia trachomatis
SGEAV

SEQ ID NO: 6934 - protein, 5 aa, Chlamydia trachomatis
GEAVC

SEQ ID NO: 6935 - protein, 5 aa, Chlamydia trachomatis
EAVCD

SEQ ID NO: 6936 - protein, 5 aa, Chlamydia trachomatis
AVCDE

SEQ ID NO: 6937 - protein, 5 aa, Chlamydia trachomatis
VCDEI

SEQ ID NO: 6938 - protein, 5 aa, Chlamydia trachomatis
CDEIA

SEQ ID NO: 6939 - protein, 5 aa, Chlamydia trachomatis
DEIAL

SEQ ID NO: 6940 - protein, 5 aa, Chlamydia trachomatis
EIALG

SEQ ID NO: 6941 - protein, 5 aa, Chlamydia trachomatis
IALGD

SEQ ID NO: 6942 - protein, 5 aa, Chlamydia trachomatis
ALGDG

SEQ ID NO: 6943 - protein, 5 aa, Chlamydia trachomatis
LGDGF

SEQ ID NO: 6944 - protein, 5 aa, Chlamydia trachomatis
GDGFH

SEQ ID NO: 6945 - protein, 5 aa, Chlamydia trachomatis
DGFHK

SEQ ID NO: 6946 - protein, 5 aa, Chlamydia trachomatis
GFHKV

SEQ ID NO: 6947 - protein, 5 aa, Chlamydia trachomatis
FHKVL

SEQ ID NO: 6948 - protein, 5 aa, Chlamydia trachomatis
HKVLG

SEQ ID NO: 6949 - protein, 5 aa, Chlamydia trachomatis
KVLGT

SEQ ID NO: 6950 - protein, 5 aa, Chlamydia trachomatis
VLGTM

SEQ ID NO: 6951 - protein, 5 aa, Chlamydia trachomatis
LGTML

SEQ ID NO: 6952 - protein, 5 aa, Chlamydia trachomatis
GTMLA

SEQ ID NO: 6953 - protein, 5 aa, Chlamydia trachomatis
TMLAV

SEQ ID NO: 6954 - protein, 5 aa, Chlamydia trachomatis
MLAVA

SEQ ID NO: 6955 - protein, 5 aa, Chlamydia trachomatis
LAVAL

SEQ ID NO: 6956 - protein, 5 aa, Chlamydia trachomatis
AVALS

SEQ ID NO: 6957 - protein, 5 aa, Chlamydia trachomatis
VALSQ

SEQ ID NO: 6958 - protein, 5 aa, Chlamydia trachomatis
ALSQA

SEQ ID NO: 6959 - protein, 5 aa, Chlamydia trachomatis
LSQAE

SEQ ID NO: 6960 - protein, 5 aa, Chlamydia trachomatis
SQAEV

SEQ ID NO: 6961 - protein, 5 aa, Chlamydia trachomatis
QAEVF

SEQ ID NO: 6962 - protein, 5 aa, Chlamydia trachomatis
AEVFK

SEQ ID NO: 6963 - protein, 5 aa, Chlamydia trachomatis
EVFKQ

SEQ ID NO: 6964 - protein, 5 aa, Chlamydia trachomatis
VFKQE

SEQ ID NO: 6965 - protein, 5 aa, Chlamydia trachomatis
FKQEC

SEQ ID NO: 6966 - protein, 5 aa, Chlamydia trachomatis
KQECD

SEQ ID NO: 6967 - protein, 5 aa, Chlamydia trachomatis
QECDR

SEQ ID NO: 6968 - protein, 5 aa, Chlamydia trachomatis
ECDRF

SEQ ID NO: 6969 - protein, 5 aa, Chlamydia trachomatis
CDRFI

SEQ ID NO: 6970 - protein, 5 aa, Chlamydia trachomatis
DRFIL

SEQ ID NO: 6971 - protein, 5 aa, Chlamydia trachomatis
RFILQ

SEQ ID NO: 6972 - protein, 5 aa, Chlamydia trachomatis
FILQA

SEQ ID NO: 6973 - protein, 5 aa, Chlamydia trachomatis
ILQAD

SEQ ID NO: 6974 - protein, 5 aa, Chlamydia trachomatis
LQADS

SEQ ID NO: 6975 - protein, 5 aa, Chlamydia trachomatis
QADSE

SEQ ID NO: 6976 - protein, 5 aa, Chlamydia trachomatis
ADSEK

SEQ ID NO: 6977 - protein, 5 aa, Chlamydia trachomatis
DSEKN

SEQ ID NO: 6978 - protein, 5 aa, Chlamydia trachomatis
SEKNM

SEQ ID NO: 6979 - protein, 5 aa, Chlamydia trachomatis
EKNMI

SEQ ID NO: 6980 - protein, 5 aa, Chlamydia trachomatis
KNMIH

SEQ ID NO: 6981 - protein, 5 aa, Chlamydia trachomatis
NMIHK

SEQ ID NO: 6982 - protein, 5 aa, Chlamydia trachomatis
MIHKR

SEQ ID NO: 6983 - protein, 5 aa, Chlamydia trachomatis
IHKRM

SEQ ID NO: 6984 - protein, 5 aa, Chlamydia trachomatis
HKRMV

SEQ ID NO: 6985 - protein, 5 aa, Chlamydia trachomatis
KRMVQ

SEQ ID NO: 6986 - protein, 5 aa, Chlamydia trachomatis
RMVQG

SEQ ID NO: 6987 - protein, 5 aa, Chlamydia trachomatis
MVQGE

SEQ ID NO: 6988 - protein, 5 aa, Chlamydia trachomatis
VQGEQ

SEQ ID NO: 6989 - protein, 5 aa, Chlamydia trachomatis
QGEQK

SEQ ID NO: 6990 - protein, 5 aa, Chlamydia trachomatis
GEQKS

SEQ ID NO: 6991 - protein, 5 aa, Chlamydia trachomatis
EQKSL

SEQ ID NO: 6992 - protein, 5 aa, Chlamydia trachomatis
QKSLF

SEQ ID NO: 6993 - protein, 5 aa, Chlamydia trachomatis
KSLFL

SEQ ID NO: 6994 - protein, 5 aa, Chlamydia trachomatis
SLFLT

SEQ ID NO: 6995 - protein, 5 aa, Chlamydia trachomatis
LFLTK

SEQ ID NO: 6996 - protein, 5 aa, Chlamydia trachomatis
FLTKM

SEQ ID NO: 6997 - protein, 5 aa, Chlamydia trachomatis
LTKMQ

SEQ ID NO: 6998 - protein, 5 aa, Chlamydia trachomatis
TKMQT

SEQ ID NO: 6999 - protein, 5 aa, Chlamydia trachomatis
KMQTE

SEQ ID NO: 7000 - protein, 5 aa, Chlamydia trachomatis
MQTEL

SEQ ID NO: 7001 - protein, 5 aa, Chlamydia trachomatis
QTELN

SEQ ID NO: 7002 - protein, 5 aa, Chlamydia trachomatis
TELNA

SEQ ID NO: 7003 - protein, 5 aa, Chlamydia trachomatis
ELNAG

SEQ ID NO: 7004 - protein, 5 aa, Chlamydia trachomatis
LNAGK

SEQ ID NO: 7005 - protein, 5 aa, Chlamydia trachomatis
NAGKT

SEQ ID NO: 7006 - protein, 5 aa, Chlamydia trachomatis
AGKTI

SEQ ID NO: 7007 - protein, 5 aa, Chlamydia trachomatis
GKTIA

SEQ ID NO: 7008 - protein, 5 aa, Chlamydia trachomatis
KTIAQ

SEQ ID NO: 7009 - protein, 5 aa, Chlamydia trachomatis
TIAQT

SEQ ID NO: 7010 - protein, 5 aa, Chlamydia trachomatis
IAQTK

SEQ ID NO: 7011 - protein, 5 aa, Chlamydia trachomatis
AQTKE

SEQ ID NO: 7012 - protein, 5 aa, Chlamydia trachomatis
QTKEV

SEQ ID NO: 7013 - protein, 5 aa, Chlamydia trachomatis
TKEVE

SEQ ID NO: 7014 - protein, 5 aa, Chlamydia trachomatis
KEVEA

SEQ ID NO: 7015 - protein, 5 aa, Chlamydia trachomatis
EVEAS

SEQ ID NO: 7016 - protein, 5 aa, Chlamydia trachomatis
VEASP

SEQ ID NO: 7017 - protein, 5 aa, Chlamydia trachomatis
EASPL

SEQ ID NO: 7018 - protein, 5 aa, Chlamydia trachomatis
ASPLP

SEQ ID NO: 7019 - protein, 5 aa, Chlamydia trachomatis
SPLPS

SEQ ID NO: 7020 - protein, 5 aa, Chlamydia trachomatis
PLPSA

SEQ ID NO: 7021 - protein, 5 aa, Chlamydia trachomatis
LPSAV

SEQ ID NO: 7022 - protein, 5 aa, Chlamydia trachomatis
PSAVA

SEQ ID NO: 7023 - protein, 5 aa, Chlamydia trachomatis
SAVAS

SEQ ID NO: 7024 - protein, 5 aa, Chlamydia trachomatis
AVASV

SEQ ID NO: 7025 - protein, 5 aa, Chlamydia trachomatis
VASVL

SEQ ID NO: 7026 - protein, 5 aa, Chlamydia trachomatis
ASVLI

SEQ ID NO: 7027 - protein, 5 aa, Chlamydia trachomatis
SVLID

SEQ ID NO: 7028 - protein, 5 aa, Chlamydia trachomatis
VLIDH

SEQ ID NO: 7029 - protein, 5 aa, Chlamydia trachomatis
LIDHY

SEQ ID NO: 7030 - protein, 5 aa, Chlamydia trachomatis
IDHYM

SEQ ID NO: 7031 - protein, 5 aa, Chlamydia trachomatis
DHYMP

SEQ ID NO: 7032 - protein, 5 aa, Chlamydia trachomatis
HYMPK

SEQ ID NO: 7033 - protein, 5 aa, Chlamydia trachomatis
YMPKE

SEQ ID NO: 7034 - protein, 5 aa, Chlamydia trachomatis
MPKEV

SEQ ID NO: 7035 - protein, 5 aa, Chlamydia trachomatis
PKEVE

SEQ ID NO: 7036 - protein, 5 aa, Chlamydia trachomatis
KEVEF

SEQ ID NO: 7037 - protein, 5 aa, Chlamydia trachomatis
EVEFL

SEQ ID NO: 7038 - protein, 5 aa, Chlamydia trachomatis
VEFLE

SEQ ID NO: 7039 - protein, 5 aa, Chlamydia trachomatis
EFLEK

SEQ ID NO: 7040 - protein, 5 aa, Chlamydia trachomatis
FLEKI

SEQ ID NO: 7041 - protein, 5 aa, Chlamydia trachomatis
LEKIS

SEQ ID NO: 7042 - protein, 5 aa, Chlamydia trachomatis
EKISS

SEQ ID NO: 7043 - protein, 5 aa, Chlamydia trachomatis
KISSR

SEQ ID NO: 7044 - protein, 5 aa, Chlamydia trachomatis
ISSRL

SEQ ID NO: 7045 - protein, 5 aa, Chlamydia trachomatis
SSRLY

SEQ ID NO: 7046 - protein, 5 aa, Chlamydia trachomatis
SRLYY

SEQ ID NO: 7047 - protein, 5 aa, Chlamydia trachomatis
RLYYG

SEQ ID NO: 7048 - protein, 5 aa, Chlamydia trachomatis
LYYGN

SEQ ID NO: 7049 - protein, 5 aa, Chlamydia trachomatis
YYGNK

SEQ ID NO: 7050 - protein, 5 aa, Chlamydia trachomatis
YGNKG

SEQ ID NO: 7051 - protein, 5 aa, Chlamydia trachomatis
GNKGS

SEQ ID NO: 7052 - protein, 5 aa, Chlamydia trachomatis
NKGSD

SEQ ID NO: 7053 - protein, 5 aa, Chlamydia trachomatis
KGSDI

SEQ ID NO: 7054 - protein, 5 aa, Chlamydia trachomatis
GSDIG

SEQ ID NO: 7055 - protein, 5 aa, Chlamydia trachomatis
SDIGN

SEQ ID NO: 7056 - protein, 5 aa, Chlamydia trachomatis
DIGNT

SEQ ID NO: 7057 - protein, 5 aa, Chlamydia trachomatis
IGNTI

SEQ ID NO: 7058 - protein, 5 aa, Chlamydia trachomatis
GNTIL

SEQ ID NO: 7059 - protein, 5 aa, Chlamydia trachomatis
NTILD

SEQ ID NO: 7060 - protein, 5 aa, Chlamydia trachomatis
TILDA

SEQ ID NO: 7061 - protein, 5 aa, Chlamydia trachomatis
ILDAI

SEQ ID NO: 7062 - protein, 5 aa, Chlamydia trachomatis
LDAIS

SEQ ID NO: 7063 - protein, 5 aa, Chlamydia trachomatis
DAISL

SEQ ID NO: 7064 - protein, 5 aa, Chlamydia trachomatis
AISLY

SEQ ID NO: 7065 - protein, 5 aa, Chlamydia trachomatis
ISLYV

SEQ ID NO: 7066 - protein, 5 aa, Chlamydia trachomatis
SLYVN

SEQ ID NO: 7067 - protein, 5 aa, Chlamydia trachomatis
LYVNS

SEQ ID NO: 7068 - protein, 5 aa, Chlamydia trachomatis
YVNSA

SEQ ID NO: 7069 - protein, 5 aa, Chlamydia trachomatis
VNSAT

SEQ ID NO: 7070 - protein, 5 aa, Chlamydia trachomatis
NSATY

SEQ ID NO: 7071 - protein, 5 aa, Chlamydia trachomatis
SATYF

SEQ ID NO: 7072 - protein, 5 aa, Chlamydia trachomatis
ATYFG

SEQ ID NO: 7073 - protein, 5 aa, Chlamydia trachomatis
TYFGF

SEQ ID NO: 7074 - protein, 5 aa, Chlamydia trachomatis
YFGFA

SEQ ID NO: 7075 - protein, 5 aa, Chlamydia trachomatis
FGFAN

SEQ ID NO: 7076 - protein, 5 aa, Chlamydia trachomatis
GFANY

SEQ ID NO: 7077 - protein, 5 aa, Chlamydia trachomatis
FANYI

SEQ ID NO: 7078 - protein, 5 aa, Chlamydia trachomatis
ANYIG

SEQ ID NO: 7079 - protein, 5 aa, Chlamydia trachomatis
NYIGQ

SEQ ID NO: 7080 - protein, 5 aa, Chlamydia trachomatis
YIGQP

SEQ ID NO: 7081 - protein, 5 aa, Chlamydia trachomatis
IGQPP

SEQ ID NO: 7082 - protein, 5 aa, Chlamydia trachomatis
GQPPV

SEQ ID NO: 7083 - protein, 5 aa, Chlamydia trachomatis
QPPVV

SEQ ID NO: 7084 - protein, 5 aa, Chlamydia trachomatis
PPVVG

SEQ ID NO: 7085 - protein, 5 aa, Chlamydia trachomatis
PVVGK

SEQ ID NO: 7086 - protein, 5 aa, Chlamydia trachomatis
VVGKT

SEQ ID NO: 7087 - protein, 5 aa, Chlamydia trachomatis
VGKTR

SEQ ID NO: 7088 - protein, 5 aa, Chlamydia trachomatis
GKTRE

SEQ ID NO: 7089 - protein, 5 aa, Chlamydia trachomatis
KTREN

SEQ ID NO: 7090 - protein, 5 aa, Chlamydia trachomatis
TRENI

SEQ ID NO: 7091 - protein, 5 aa, Chlamydia trachomatis
RENIF

SEQ ID NO: 7092 - protein, 5 aa, Chlamydia trachomatis
ENIFA

SEQ ID NO: 7093 - protein, 5 aa, Chlamydia trachomatis
NIFAG

SEQ ID NO: 7094 - protein, 5 aa, Chlamydia trachomatis
IFAGS

SEQ ID NO: 7095 - protein, 5 aa, Chlamydia trachomatis
FAGSA

SEQ ID NO: 7096 - protein, 5 aa, Chlamydia trachomatis
AGSAD

SEQ ID NO: 7097 - protein, 5 aa, Chlamydia trachomatis
GSADN

SEQ ID NO: 7098 - protein, 5 aa, Chlamydia trachomatis
SADNA

SEQ ID NO: 7099 - protein, 5 aa, Chlamydia trachomatis
ADNAK

SEQ ID NO: 7100 - protein, 5 aa, Chlamydia trachomatis
DNAKA

SEQ ID NO: 7101 - protein, 5 aa, Chlamydia trachomatis
NAKAK

SEQ ID NO: 7102 - protein, 5 aa, Chlamydia trachomatis
AKAKL

SEQ ID NO: 7103 - protein, 5 aa, Chlamydia trachomatis
KAKLD

SEQ ID NO: 7104 - protein, 5 aa, Chlamydia trachomatis
AKLDE

SEQ ID NO: 7105 - protein, 5 aa, Chlamydia trachomatis
KLDEE

SEQ ID NO: 7106 - protein, 5 aa, Chlamydia trachomatis
LDEEK

SEQ ID NO: 7107 - protein, 5 aa, Chlamydia trachomatis
DEEKK

SEQ ID NO: 7108 - protein, 5 aa, Chlamydia trachomatis
EEKKQ

SEQ ID NO: 7109 - protein, 5 aa, Chlamydia trachomatis
EKKQV

SEQ ID NO: 7110 - protein, 5 aa, Chlamydia trachomatis
KKQVD

SEQ ID NO: 7111 - protein, 5 aa, Chlamydia trachomatis
KQVDV

SEQ ID NO: 7112 - protein, 5 aa, Chlamydia trachomatis
QVDVF

SEQ ID NO: 7113 - protein, 5 aa, Chlamydia trachomatis
VDVFL

SEQ ID NO: 7114 - protein, 5 aa, Chlamydia trachomatis
DVFLE

SEQ ID NO: 7115 - protein, 5 aa, Chlamydia trachomatis
VFLEI

SEQ ID NO: 7116 - protein, 5 aa, Chlamydia trachomatis
FLEIT

SEQ ID NO: 7117 - protein, 5 aa, Chlamydia trachomatis
LEITE

SEQ ID NO: 7118 - protein, 5 aa, Chlamydia trachomatis
EITEA

SEQ ID NO: 7119 - protein, 5 aa, Chlamydia trachomatis
ITEAA

SEQ ID NO: 7120 - protein, 5 aa, Chlamydia trachomatis
TEAAK

SEQ ID NO: 7121 - protein, 5 aa, Chlamydia trachomatis
EAAKT

SEQ ID NO: 7122 - protein, 5 aa, Chlamydia trachomatis
AAKTT

SEQ ID NO: 7123 - protein, 5 aa, Chlamydia trachomatis
AKTTV

SEQ ID NO: 7124 - protein, 5 aa, Chlamydia trachomatis
KTTVT

SEQ ID NO: 7125 - protein, 5 aa, Chlamydia trachomatis
TTVTN

SEQ ID NO: 7126 - protein, 5 aa, Chlamydia trachomatis
TVTNQ

SEQ ID NO: 7127 - protein, 5 aa, Chlamydia trachomatis
VTNQQ

SEQ ID NO: 7128 - protein, 5 aa, Chlamydia trachomatis
TNQQS

SEQ ID NO: 7129 - protein, 5 aa, Chlamydia trachomatis
NQQSA

SEQ ID NO: 7130 - protein, 5 aa, Chlamydia trachomatis
QQSAV

SEQ ID NO: 7131 - protein, 5 aa, Chlamydia trachomatis
QSAVT

SEQ ID NO: 7132 - protein, 5 aa, Chlamydia trachomatis
SAVTN

SEQ ID NO: 7133 - protein, 5 aa, Chlamydia trachomatis
AVTND

SEQ ID NO: 7134 - protein, 5 aa, Chlamydia trachomatis
VTNDD

SEQ ID NO: 7135 - protein, 5 aa, Chlamydia trachomatis
TNDDK

SEQ ID NO: 7136 - protein, 5 aa, Chlamydia trachomatis
NDDKL

SEQ ID NO: 7137 - protein, 5 aa, Chlamydia trachomatis
DDKLS

SEQ ID NO: 7138 - protein, 5 aa, Chlamydia trachomatis
DKLST

SEQ ID NO: 7139 - protein, 5 aa, Chlamydia trachomatis
KLSTE

SEQ ID NO: 7140 - protein, 5 aa, Chlamydia trachomatis
LSTEQ

SEQ ID NO: 7141 - protein, 5 aa, Chlamydia trachomatis
STEQK

SEQ ID NO: 7142 - protein, 5 aa, Chlamydia trachomatis
TEQKA

SEQ ID NO: 7143 - protein, 5 aa, Chlamydia trachomatis
EQKAK

SEQ ID NO: 7144 - protein, 5 aa, Chlamydia trachomatis
QKAKI

SEQ ID NO: 7145 - protein, 5 aa, Chlamydia trachomatis
KAKIK

SEQ ID NO: 7146 - protein, 5 aa, Chlamydia trachomatis
AKIKA

SEQ ID NO: 7147 - protein, 5 aa, Chlamydia trachomatis
KIKAE

SEQ ID NO: 7148 - protein, 5 aa, Chlamydia trachomatis
IKAEL

SEQ ID NO: 7149 - protein, 5 aa, Chlamydia trachomatis
KAELT

SEQ ID NO: 7150 - protein, 5 aa, Chlamydia trachomatis
AELTQ

SEQ ID NO: 7151 - protein, 5 aa, Chlamydia trachomatis
ELTQY

SEQ ID NO: 7152 - protein, 5 aa, Chlamydia trachomatis
LTQYT

SEQ ID NO: 7153 - protein, 5 aa, Chlamydia trachomatis
TQYTD

SEQ ID NO: 7154 - protein, 5 aa, Chlamydia trachomatis
QYTDM

SEQ ID NO: 7155 - protein, 5 aa, Chlamydia trachomatis
YTDML

SEQ ID NO: 7156 - protein, 5 aa, Chlamydia trachomatis
TDMLN

SEQ ID NO: 7157 - protein, 5 aa, Chlamydia trachomatis
DMLNA

SEQ ID NO: 7158 - protein, 5 aa, Chlamydia trachomatis
MLNAI

SEQ ID NO: 7159 - protein, 5 aa, Chlamydia trachomatis
LNAIS

SEQ ID NO: 7160 - protein, 5 aa, Chlamydia trachomatis
NAISN

SEQ ID NO: 7161 - protein, 5 aa, Chlamydia trachomatis
AISNS

SEQ ID NO: 7162 - protein, 5 aa, Chlamydia trachomatis
ISNSL

SEQ ID NO: 7163 - protein, 5 aa, Chlamydia trachomatis
SNSLT

SEQ ID NO: 7164 - protein, 5 aa, Chlamydia trachomatis
NSLTS

SEQ ID NO: 7165 - protein, 5 aa, Chlamydia trachomatis
SLTSL

SEQ ID NO: 7166 - protein, 5 aa, Chlamydia trachomatis
LTSLK

SEQ ID NO: 7167 - protein, 5 aa, Chlamydia trachomatis
TSLKT

SEQ ID NO: 7168 - protein, 5 aa, Chlamydia trachomatis
SLKTQ

SEQ ID NO: 7169 - protein, 5 aa, Chlamydia trachomatis
LKTQL

SEQ ID NO: 7170 - protein, 5 aa, Chlamydia trachomatis
KTQLA

SEQ ID NO: 7171 - protein, 5 aa, Chlamydia trachomatis
TQLAP

SEQ ID NO: 7172 - protein, 5 aa, Chlamydia trachomatis
QLAPL

SEQ ID NO: 7173 - protein, 5 aa, Chlamydia trachomatis
LAPLS

SEQ ID NO: 7174 - protein, 5 aa, Chlamydia trachomatis
APLSV

SEQ ID NO: 7175 - protein, 5 aa, Chlamydia trachomatis
PLSVS

SEQ ID NO: 7176 - protein, 5 aa, Chlamydia trachomatis
LSVST

SEQ ID NO: 7177 - protein, 5 aa, Chlamydia trachomatis
SVSTV

SEQ ID NO: 7178 - protein, 5 aa, Chlamydia trachomatis
VSTVE

SEQ ID NO: 7179 - protein, 5 aa, Chlamydia trachomatis
STVEG

SEQ ID NO: 7180 - protein, 5 aa, Chlamydia trachomatis
TVEGV

SEQ ID NO: 7181 - protein, 5 aa, Chlamydia trachomatis
VEGVD

SEQ ID NO: 7182 - protein, 5 aa, Chlamydia trachomatis
EGVDG

SEQ ID NO: 7183 - protein, 5 aa, Chlamydia trachomatis
GVDGV

SEQ ID NO: 7184 - protein, 5 aa, Chlamydia trachomatis
VDGVF

SEQ ID NO: 7185 - protein, 5 aa, Chlamydia trachomatis
DGVFE

SEQ ID NO: 7186 - protein, 5 aa, Chlamydia trachomatis
GVFEV

SEQ ID NO: 7187 - protein, 5 aa, Chlamydia trachomatis
VFEVK

SEQ ID NO: 7188 - protein, 5 aa, Chlamydia trachomatis
FEVKN

SEQ ID NO: 7189 - protein, 5 aa, Chlamydia trachomatis
EVKNG

SEQ ID NO: 7190 - protein, 5 aa, Chlamydia trachomatis
VKNGI

SEQ ID NO: 7191 - protein, 5 aa, Chlamydia trachomatis
KNGIP

SEQ ID NO: 7192 - protein, 5 aa, Chlamydia trachomatis
NGIPG

SEQ ID NO: 7193 - protein, 5 aa, Chlamydia trachomatis
GIPGE

SEQ ID NO: 7194 - protein, 5 aa, Chlamydia trachomatis
IPGEN

SEQ ID NO: 7195 - protein, 5 aa, Chlamydia trachomatis
PGENG

SEQ ID NO: 7196 - protein, 5 aa, Chlamydia trachomatis
GENGK

SEQ ID NO: 7197 - protein, 5 aa, Chlamydia trachomatis
ENGKN

SEQ ID NO: 7198 - protein, 5 aa, Chlamydia trachomatis
NGKNW

SEQ ID NO: 7199 - protein, 5 aa, Chlamydia trachomatis
GKNWR

SEQ ID NO: 7200 - protein, 5 aa, Chlamydia trachomatis
KNWRL

SEQ ID NO: 7201 - protein, 5 aa, Chlamydia trachomatis
NWRLV

SEQ ID NO: 7202 - protein, 5 aa, Chlamydia trachomatis
WRLVL

SEQ ID NO: 7203 - protein, 5 aa, Chlamydia trachomatis
RLVLQ

SEQ ID NO: 7204 - protein, 5 aa, Chlamydia trachomatis
LVLQT

SEQ ID NO: 7205 - protein, 5 aa, Chlamydia trachomatis
VLQTL

SEQ ID NO: 7206 - protein, 5 aa, Chlamydia trachomatis
LQTLE

SEQ ID NO: 7207 - protein, 5 aa, Chlamydia trachomatis
QTLED

SEQ ID NO: 7208 - protein, 5 aa, Chlamydia trachomatis
TLEDT

SEQ ID NO: 7209 - protein, 5 aa, Chlamydia trachomatis
LEDTV

SEQ ID NO: 7210 - protein, 5 aa, Chlamydia trachomatis
EDTVV

SEQ ID NO: 7211 - protein, 5 aa, Chlamydia trachomatis
DTVVS

SEQ ID NO: 7212 - protein, 5 aa, Chlamydia trachomatis
TVVSG

SEQ ID NO: 7213 - protein, 5 aa, Chlamydia trachomatis
VVSGE

SEQ ID NO: 7214 - protein, 5 aa, Chlamydia trachomatis
VSGEV

SEQ ID NO: 7215 - protein, 5 aa, Chlamydia trachomatis
SGEVG

SEQ ID NO: 7216 - protein, 5 aa, Chlamydia trachomatis
GEVGS

SEQ ID NO: 7217 - protein, 5 aa, Chlamydia trachomatis
EVGSP

SEQ ID NO: 7218 - protein, 5 aa, Chlamydia trachomatis
VGSPT

SEQ ID NO: 7219 - protein, 5 aa, Chlamydia trachomatis
GSPTN

SEQ ID NO: 7220 - protein, 5 aa, Chlamydia trachomatis
SPTNI

SEQ ID NO: 7221 - protein, 5 aa, Chlamydia trachomatis
PTNIG

SEQ ID NO: 7222 - protein, 5 aa, Chlamydia trachomatis
TNIGM

SEQ ID NO: 7223 - protein, 5 aa, Chlamydia trachomatis
NIGMF

SEQ ID NO: 7224 - protein, 5 aa, Chlamydia trachomatis
IGMFQ

SEQ ID NO: 7225 - protein, 5 aa, Chlamydia trachomatis
GMFQM

SEQ ID NO: 7226 - protein, 5 aa, Chlamydia trachomatis
MFQMQ

SEQ ID NO: 7227 - protein, 5 aa, Chlamydia trachomatis
FQMQA

SEQ ID NO: 7228 - protein, 5 aa, Chlamydia trachomatis
QMQAL

SEQ ID NO: 7229 - protein, 5 aa, Chlamydia trachomatis
MQALV

SEQ ID NO: 7230 - protein, 5 aa, Chlamydia trachomatis
QALVH

SEQ ID NO: 7231 - protein, 5 aa, Chlamydia trachomatis
ALVHL

SEQ ID NO: 7232 - protein, 5 aa, Chlamydia trachomatis
LVHLN

SEQ ID NO: 7233 - protein, 5 aa, Chlamydia trachomatis
VHLNQ

SEQ ID NO: 7234 - protein, 5 aa, Chlamydia trachomatis
HLNQQ

SEQ ID NO: 7235 - protein, 5 aa, Chlamydia trachomatis
LNQQA

SEQ ID NO: 7236 - protein, 5 aa, Chlamydia trachomatis
NQQAY

SEQ ID NO: 7237 - protein, 5 aa, Chlamydia trachomatis
QQAYA

SEQ ID NO: 7238 - protein, 5 aa, Chlamydia trachomatis
QAYAD

SEQ ID NO: 7239 - protein, 5 aa, Chlamydia trachomatis
AYADM

SEQ ID NO: 7240 - protein, 5 aa, Chlamydia trachomatis
YADMG

SEQ ID NO: 7241 - protein, 5 aa, Chlamydia trachomatis
ADMGQ

SEQ ID NO: 7242 - protein, 5 aa, Chlamydia trachomatis
DMGQN

SEQ ID NO: 7243 - protein, 5 aa, Chlamydia trachomatis
MGQNF

SEQ ID NO: 7244 - protein, 5 aa, Chlamydia trachomatis
GQNFQ

SEQ ID NO: 7245 - protein, 5 aa, Chlamydia trachomatis
QNFQL

SEQ ID NO: 7246 - protein, 5 aa, Chlamydia trachomatis
NFQLE

SEQ ID NO: 7247 - protein, 5 aa, Chlamydia trachomatis
FQLEL

SEQ ID NO: 7248 - protein, 5 aa, Chlamydia trachomatis
QLELQ

SEQ ID NO: 7249 - protein, 5 aa, Chlamydia trachomatis
LELQM

SEQ ID NO: 7250 - protein, 5 aa, Chlamydia trachomatis
ELQMH

SEQ ID NO: 7251 - protein, 5 aa, Chlamydia trachomatis
LQMHL

SEQ ID NO: 7252 - protein, 5 aa, Chlamydia trachomatis
QMHLT

SEQ ID NO: 7253 - protein, 5 aa, Chlamydia trachomatis
MHLTS

SEQ ID NO: 7254 - protein, 5 aa, Chlamydia trachomatis
HLTSM

SEQ ID NO: 7255 - protein, 5 aa, Chlamydia trachomatis
LTSMQ

SEQ ID NO: 7256 - protein, 5 aa, Chlamydia trachomatis
TSMQQ

SEQ ID NO: 7257 - protein, 5 aa, Chlamydia trachomatis
SMQQE

SEQ ID NO: 7258 - protein, 5 aa, Chlamydia trachomatis
MQQEW

SEQ ID NO: 7259 - protein, 5 aa, Chlamydia trachomatis
QQEWM

SEQ ID NO: 7260 - protein, 5 aa, Chlamydia trachomatis
QEWMV

SEQ ID NO: 7261 - protein, 5 aa, Chlamydia trachomatis
EWMVV

SEQ ID NO: 7262 - protein, 5 aa, Chlamydia trachomatis
WMVVA

SEQ ID NO: 7263 - protein, 5 aa, Chlamydia trachomatis
MVVAT

SEQ ID NO: 7264 - protein, 5 aa, Chlamydia trachomatis
VVATS

SEQ ID NO: 7265 - protein, 5 aa, Chlamydia trachomatis
VATSL

SEQ ID NO: 7266 - protein, 5 aa, Chlamydia trachomatis
ATSLQ

SEQ ID NO: 7267 - protein, 5 aa, Chlamydia trachomatis
TSLQL

SEQ ID NO: 7268 - protein, 5 aa, Chlamydia trachomatis
SLQLL

SEQ ID NO: 7269 - protein, 5 aa, Chlamydia trachomatis
LQLLN

SEQ ID NO: 7270 - protein, 5 aa, Chlamydia trachomatis
QLLNQ

SEQ ID NO: 7271 - protein, 5 aa, Chlamydia trachomatis
LLNQI

SEQ ID NO: 7272 - protein, 5 aa, Chlamydia trachomatis
LNQIY

SEQ ID NO: 7273 - protein, 5 aa, Chlamydia trachomatis
NQIYL

SEQ ID NO: 7274 - protein, 5 aa, Chlamydia trachomatis
QIYLG

SEQ ID NO: 7275 - protein, 5 aa, Chlamydia trachomatis
IYLGL

SEQ ID NO: 7276 - protein, 5 aa, Chlamydia trachomatis
YLGLA

SEQ ID NO: 7277 - protein, 5 aa, Chlamydia trachomatis
LGLAR

SEQ ID NO: 7278 - protein, 5 aa, Chlamydia trachomatis
GLARN

SEQ ID NO: 7279 - protein, 5 aa, Chlamydia trachomatis
LARNL

SEQ ID NO: 7280 - protein, 5 aa, Chlamydia trachomatis
ARNLL

SEQ ID NO: 7281 - protein, 5 aa, Chlamydia trachomatis
RNLLR

SEQ ID NO: 7282 - protein, 5 aa, Chlamydia trachomatis
MESGP

SEQ ID NO: 7283 - protein, 5 aa, Chlamydia trachomatis
ESGPE

SEQ ID NO: 7284 - protein, 5 aa, Chlamydia trachomatis
SGPES

SEQ ID NO: 7285 - protein, 5 aa, Chlamydia trachomatis
GPESV

SEQ ID NO: 7286 - protein, 5 aa, Chlamydia trachomatis
PESVS

SEQ ID NO: 7287 - protein, 5 aa, Chlamydia trachomatis
ESVSS

SEQ ID NO: 7288 - protein, 5 aa, Chlamydia trachomatis
SVSSN

SEQ ID NO: 7289 - protein, 5 aa, Chlamydia trachomatis
VSSNQ

SEQ ID NO: 7290 - protein, 5 aa, Chlamydia trachomatis
SSNQS

SEQ ID NO: 7291 - protein, 5 aa, Chlamydia trachomatis
SNQSS

SEQ ID NO: 7292 - protein, 5 aa, Chlamydia trachomatis
NQSSM

SEQ ID NO: 7293 - protein, 5 aa, Chlamydia trachomatis
QSSMN

SEQ ID NO: 7294 - protein, 5 aa, Chlamydia trachomatis
SSMNP

SEQ ID NO: 7295 - protein, 5 aa, Chlamydia trachomatis
SMNPI

SEQ ID NO: 7296 - protein, 5 aa, Chlamydia trachomatis
MNPII

SEQ ID NO: 7297 - protein, 5 aa, Chlamydia trachomatis
NPIIN

SEQ ID NO: 7298 - protein, 5 aa, Chlamydia trachomatis
PIING

SEQ ID NO: 7299 - protein, 5 aa, Chlamydia trachomatis
IINGQ

SEQ ID NO: 7300 - protein, 5 aa, Chlamydia trachomatis
INGQI

SEQ ID NO: 7301 - protein, 5 aa, Chlamydia trachomatis
NGQIA

SEQ ID NO: 7302 - protein, 5 aa, Chlamydia trachomatis
GQIAS

SEQ ID NO: 7303 - protein, 5 aa, Chlamydia trachomatis
QIASN

SEQ ID NO: 7304 - protein, 5 aa, Chlamydia trachomatis
IASNS

SEQ ID NO: 7305 - protein, 5 aa, Chlamydia trachomatis
ASNSE

SEQ ID NO: 7306 - protein, 5 aa, Chlamydia trachomatis
SNSET

SEQ ID NO: 7307 - protein, 5 aa, Chlamydia trachomatis
NSETK

SEQ ID NO: 7308 - protein, 5 aa, Chlamydia trachomatis
SETKE

SEQ ID NO: 7309 - protein, 5 aa, Chlamydia trachomatis
ETKES

SEQ ID NO: 7310 - protein, 5 aa, Chlamydia trachomatis
TKEST

SEQ ID NO: 7311 - protein, 5 aa, Chlamydia trachomatis
KESTK

SEQ ID NO: 7312 - protein, 5 aa, Chlamydia trachomatis
ESTKE

SEQ ID NO: 7313 - protein, 5 aa, Chlamydia trachomatis
STKES

SEQ ID NO: 7314 - protein, 5 aa, Chlamydia trachomatis
TKESE

SEQ ID NO: 7315 - protein, 5 aa, Chlamydia trachomatis
KESEA

SEQ ID NO: 7316 - protein, 5 aa, Chlamydia trachomatis
ESEAS

SEQ ID NO: 7317 - protein, 5 aa, Chlamydia trachomatis
SEASP

SEQ ID NO: 7318 - protein, 5 aa, Chlamydia trachomatis
EASPS

SEQ ID NO: 7319 - protein, 5 aa, Chlamydia trachomatis
ASPSA

SEQ ID NO: 7320 - protein, 5 aa, Chlamydia trachomatis
SPSAS

SEQ ID NO: 7321 - protein, 5 aa, Chlamydia trachomatis
PSASS

SEQ ID NO: 7322 - protein, 5 aa, Chlamydia trachomatis
SASSS

SEQ ID NO: 7323 - protein, 5 aa, Chlamydia trachomatis
ASSSV

SEQ ID NO: 7324 - protein, 5 aa, Chlamydia trachomatis
SSSVS

SEQ ID NO: 7325 - protein, 5 aa, Chlamydia trachomatis
SSVSS

SEQ ID NO: 7326 - protein, 5 aa, Chlamydia trachomatis
SVSSW

SEQ ID NO: 7327 - protein, 5 aa, Chlamydia trachomatis
VSSWS

SEQ ID NO: 7328 - protein, 5 aa, Chlamydia trachomatis
SSWSF

SEQ ID NO: 7329 - protein, 5 aa, Chlamydia trachomatis
SWSFL

SEQ ID NO: 7330 - protein, 5 aa, Chlamydia trachomatis
WSFLS

SEQ ID NO: 7331 - protein, 5 aa, Chlamydia trachomatis
SFLSS

SEQ ID NO: 7332 - protein, 5 aa, Chlamydia trachomatis
FLSSA

SEQ ID NO: 7333 - protein, 5 aa, Chlamydia trachomatis
LSSAK

SEQ ID NO: 7334 - protein, 5 aa, Chlamydia trachomatis
SSAKH

SEQ ID NO: 7335 - protein, 5 aa, Chlamydia trachomatis
SAKHA

SEQ ID NO: 7336 - protein, 5 aa, Chlamydia trachomatis
AKHAL

SEQ ID NO: 7337 - protein, 5 aa, Chlamydia trachomatis
KHALI

SEQ ID NO: 7338 - protein, 5 aa, Chlamydia trachomatis
HALIS

SEQ ID NO: 7339 - protein, 5 aa, Chlamydia trachomatis
ALISL

SEQ ID NO: 7340 - protein, 5 aa, Chlamydia trachomatis
LISLR

SEQ ID NO: 7341 - protein, 5 aa, Chlamydia trachomatis
ISLRD

SEQ ID NO: 7342 - protein, 5 aa, Chlamydia trachomatis
SLRDA

SEQ ID NO: 7343 - protein, 5 aa, Chlamydia trachomatis
LRDAI

SEQ ID NO: 7344 - protein, 5 aa, Chlamydia trachomatis
RDAIL

SEQ ID NO: 7345 - protein, 5 aa, Chlamydia trachomatis
DAILN

SEQ ID NO: 7346 - protein, 5 aa, Chlamydia trachomatis
AILNK

SEQ ID NO: 7347 - protein, 5 aa, Chlamydia trachomatis
ILNKN

SEQ ID NO: 7348 - protein, 5 aa, Chlamydia trachomatis
LNKNS

SEQ ID NO: 7349 - protein, 5 aa, Chlamydia trachomatis
NKNSS

SEQ ID NO: 7350 - protein, 5 aa, Chlamydia trachomatis
KNSSP

SEQ ID NO: 7351 - protein, 5 aa, Chlamydia trachomatis
NSSPT

SEQ ID NO: 7352 - protein, 5 aa, Chlamydia trachomatis
SSPTD

SEQ ID NO: 7353 - protein, 5 aa, Chlamydia trachomatis
SPTDS

SEQ ID NO: 7354 - protein, 5 aa, Chlamydia trachomatis
PTDSL

SEQ ID NO: 7355 - protein, 5 aa, Chlamydia trachomatis
TDSLS

SEQ ID NO: 7356 - protein, 5 aa, Chlamydia trachomatis
DSLSQ

SEQ ID NO: 7357 - protein, 5 aa, Chlamydia trachomatis
SLSQL

SEQ ID NO: 7358 - protein, 5 aa, Chlamydia trachomatis
LSQLE

SEQ ID NO: 7359 - protein, 5 aa, Chlamydia trachomatis
SQLEA

SEQ ID NO: 7360 - protein, 5 aa, Chlamydia trachomatis
QLEAS

SEQ ID NO: 7361 - protein, 5 aa, Chlamydia trachomatis
LEAST

SEQ ID NO: 7362 - protein, 5 aa, Chlamydia trachomatis
EASTS

SEQ ID NO: 7363 - protein, 5 aa, Chlamydia trachomatis
ASTST

SEQ ID NO: 7364 - protein, 5 aa, Chlamydia trachomatis
STSTS

SEQ ID NO: 7365 - protein, 5 aa, Chlamydia trachomatis
TSTST

SEQ ID NO: 7366 - protein, 5 aa, Chlamydia trachomatis
STSTV

SEQ ID NO: 7367 - protein, 5 aa, Chlamydia trachomatis
TSTVT

SEQ ID NO: 7368 - protein, 5 aa, Chlamydia trachomatis
STVTR

SEQ ID NO: 7369 - protein, 5 aa, Chlamydia trachomatis
TVTRV

SEQ ID NO: 7370 - protein, 5 aa, Chlamydia trachomatis
VTRVA

SEQ ID NO: 7371 - protein, 5 aa, Chlamydia trachomatis
TRVAA

SEQ ID NO: 7372 - protein, 5 aa, Chlamydia trachomatis
RVAAR

SEQ ID NO: 7373 - protein, 5 aa, Chlamydia trachomatis
VAARD

SEQ ID NO: 7374 - protein, 5 aa, Chlamydia trachomatis
AARDY

SEQ ID NO: 7375 - protein, 5 aa, Chlamydia trachomatis
ARDYN

SEQ ID NO: 7376 - protein, 5 aa, Chlamydia trachomatis
RDYNE

SEQ ID NO: 7377 - protein, 5 aa, Chlamydia trachomatis
DYNEA

SEQ ID NO: 7378 - protein, 5 aa, Chlamydia trachomatis
YNEAK

SEQ ID NO: 7379 - protein, 5 aa, Chlamydia trachomatis
NEAKS

SEQ ID NO: 7380 - protein, 5 aa, Chlamydia trachomatis
EAKSN

SEQ ID NO: 7381 - protein, 5 aa, Chlamydia trachomatis
AKSNF

SEQ ID NO: 7382 - protein, 5 aa, Chlamydia trachomatis
KSNFD

SEQ ID NO: 7383 - protein, 5 aa, Chlamydia trachomatis
SNFDT

SEQ ID NO: 7384 - protein, 5 aa, Chlamydia trachomatis
NFDTA

SEQ ID NO: 7385 - protein, 5 aa, Chlamydia trachomatis
FDTAK

SEQ ID NO: 7386 - protein, 5 aa, Chlamydia trachomatis
DTAKS

SEQ ID NO: 7387 - protein, 5 aa, Chlamydia trachomatis
TAKSG

SEQ ID NO: 7388 - protein, 5 aa, Chlamydia trachomatis
AKSGL

SEQ ID NO: 7389 - protein, 5 aa, Chlamydia trachomatis
KSGLE

SEQ ID NO: 7390 - protein, 5 aa, Chlamydia trachomatis
SGLEN

SEQ ID NO: 7391 - protein, 5 aa, Chlamydia trachomatis
GLENA

SEQ ID NO: 7392 - protein, 5 aa, Chlamydia trachomatis
LENAT

SEQ ID NO: 7393 - protein, 5 aa, Chlamydia trachomatis
ENATT

SEQ ID NO: 7394 - protein, 5 aa, Chlamydia trachomatis
NATTL

SEQ ID NO: 7395 - protein, 5 aa, Chlamydia trachomatis
ATTLA

SEQ ID NO: 7396 - protein, 5 aa, Chlamydia trachomatis
TTLAE

SEQ ID NO: 7397 - protein, 5 aa, Chlamydia trachomatis
TLAEY

SEQ ID NO: 7398 - protein, 5 aa, Chlamydia trachomatis
LAEYE

SEQ ID NO: 7399 - protein, 5 aa, Chlamydia trachomatis
AEYET

SEQ ID NO: 7400 - protein, 5 aa, Chlamydia trachomatis
EYETK

SEQ ID NO: 7401 - protein, 5 aa, Chlamydia trachomatis
YETKM

SEQ ID NO: 7402 - protein, 5 aa, Chlamydia trachomatis
ETKMA

SEQ ID NO: 7403 - protein, 5 aa, Chlamydia trachomatis
TKMAD

SEQ ID NO: 7404 - protein, 5 aa, Chlamydia trachomatis
KMADL

SEQ ID NO: 7405 - protein, 5 aa, Chlamydia trachomatis
MADLM

SEQ ID NO: 7406 - protein, 5 aa, Chlamydia trachomatis
ADLMA

SEQ ID NO: 7407 - protein, 5 aa, Chlamydia trachomatis
DLMAA

SEQ ID NO: 7408 - protein, 5 aa, Chlamydia trachomatis
LMAAL

SEQ ID NO: 7409 - protein, 5 aa, Chlamydia trachomatis
MAALQ

SEQ ID NO: 7410 - protein, 5 aa, Chlamydia trachomatis
AALQD

SEQ ID NO: 7411 - protein, 5 aa, Chlamydia trachomatis
ALQDM

SEQ ID NO: 7412 - protein, 5 aa, Chlamydia trachomatis
LQDME

SEQ ID NO: 7413 - protein, 5 aa, Chlamydia trachomatis
QDMER

SEQ ID NO: 7414 - protein, 5 aa, Chlamydia trachomatis
DMERL

SEQ ID NO: 7415 - protein, 5 aa, Chlamydia trachomatis
MERLA

SEQ ID NO: 7416 - protein, 5 aa, Chlamydia trachomatis
ERLAK

SEQ ID NO: 7417 - protein, 5 aa, Chlamydia trachomatis
RLAKQ

SEQ ID NO: 7418 - protein, 5 aa, Chlamydia trachomatis
LAKQK

SEQ ID NO: 7419 - protein, 5 aa, Chlamydia trachomatis
AKQKA

SEQ ID NO: 7420 - protein, 5 aa, Chlamydia trachomatis
KQKAE

SEQ ID NO: 7421 - protein, 5 aa, Chlamydia trachomatis
QKAEV

SEQ ID NO: 7422 - protein, 5 aa, Chlamydia trachomatis
KAEVT

SEQ ID NO: 7423 - protein, 5 aa, Chlamydia trachomatis
AEVTR

SEQ ID NO: 7424 - protein, 5 aa, Chlamydia trachomatis
EVTRI

SEQ ID NO: 7425 - protein, 5 aa, Chlamydia trachomatis
VTRIK

SEQ ID NO: 7426 - protein, 5 aa, Chlamydia trachomatis
TRIKE

SEQ ID NO: 7427 - protein, 5 aa, Chlamydia trachomatis
RIKEA

SEQ ID NO: 7428 - protein, 5 aa, Chlamydia trachomatis
IKEAL

SEQ ID NO: 7429 - protein, 5 aa, Chlamydia trachomatis
KEALQ

SEQ ID NO: 7430 - protein, 5 aa, Chlamydia trachomatis
EALQE

SEQ ID NO: 7431 - protein, 5 aa, Chlamydia trachomatis
ALQEK

SEQ ID NO: 7432 - protein, 5 aa, Chlamydia trachomatis
LQEKQ

SEQ ID NO: 7433 - protein, 5 aa, Chlamydia trachomatis
QEKQE

SEQ ID NO: 7434 - protein, 5 aa, Chlamydia trachomatis
EKQEV

SEQ ID NO: 7435 - protein, 5 aa, Chlamydia trachomatis
KQEVI

SEQ ID NO: 7436 - protein, 5 aa, Chlamydia trachomatis
QEVID

SEQ ID NO: 7437 - protein, 5 aa, Chlamydia trachomatis
EVIDK

SEQ ID NO: 7438 - protein, 5 aa, Chlamydia trachomatis
VIDKL

SEQ ID NO: 7439 - protein, 5 aa, Chlamydia trachomatis
IDKLN

SEQ ID NO: 7440 - protein, 5 aa, Chlamydia trachomatis
DKLNQ

SEQ ID NO: 7441 - protein, 5 aa, Chlamydia trachomatis
KLNQL

SEQ ID NO: 7442 - protein, 5 aa, Chlamydia trachomatis
LNQLV

SEQ ID NO: 7443 - protein, 5 aa, Chlamydia trachomatis
NQLVK

SEQ ID NO: 7444 - protein, 5 aa, Chlamydia trachomatis
QLVKL

SEQ ID NO: 7445 - protein, 5 aa, Chlamydia trachomatis
LVKLE

SEQ ID NO: 7446 - protein, 5 aa, Chlamydia trachomatis
VKLEK

SEQ ID NO: 7447 - protein, 5 aa, Chlamydia trachomatis
KLEKQ

SEQ ID NO: 7448 - protein, 5 aa, Chlamydia trachomatis
LEKQN

SEQ ID NO: 7449 - protein, 5 aa, Chlamydia trachomatis
EKQNQ

SEQ ID NO: 7450 - protein, 5 aa, Chlamydia trachomatis
KQNQT

SEQ ID NO: 7451 - protein, 5 aa, Chlamydia trachomatis
QNQTL

SEQ ID NO: 7452 - protein, 5 aa, Chlamydia trachomatis
NQTLK

SEQ ID NO: 7453 - protein, 5 aa, Chlamydia trachomatis
QTLKE

SEQ ID NO: 7454 - protein, 5 aa, Chlamydia trachomatis
TLKET

SEQ ID NO: 7455 - protein, 5 aa, Chlamydia trachomatis
LKETL

SEQ ID NO: 7456 - protein, 5 aa, Chlamydia trachomatis
KETLT

SEQ ID NO: 7457 - protein, 5 aa, Chlamydia trachomatis
ETLTT

SEQ ID NO: 7458 - protein, 5 aa, Chlamydia trachomatis
TLTTT

SEQ ID NO: 7459 - protein, 5 aa, Chlamydia trachomatis
LTTTD

SEQ ID NO: 7460 - protein, 5 aa, Chlamydia trachomatis
TTTDS

SEQ ID NO: 7461 - protein, 5 aa, Chlamydia trachomatis
TTDSA

SEQ ID NO: 7462 - protein, 5 aa, Chlamydia trachomatis
TDSAD

SEQ ID NO: 7463 - protein, 5 aa, Chlamydia trachomatis
DSADQ

SEQ ID NO: 7464 - protein, 5 aa, Chlamydia trachomatis
SADQI

SEQ ID NO: 7465 - protein, 5 aa, Chlamydia trachomatis
ADQIP

SEQ ID NO: 7466 - protein, 5 aa, Chlamydia trachomatis
DQIPA

SEQ ID NO: 7467 - protein, 5 aa, Chlamydia trachomatis
QIPAI

SEQ ID NO: 7468 - protein, 5 aa, Chlamydia trachomatis
IPAIN

SEQ ID NO: 7469 - protein, 5 aa, Chlamydia trachomatis
PAINS

SEQ ID NO: 7470 - protein, 5 aa, Chlamydia trachomatis
AINSQ

SEQ ID NO: 7471 - protein, 5 aa, Chlamydia trachomatis
INSQL

SEQ ID NO: 7472 - protein, 5 aa, Chlamydia trachomatis
NSQLE

SEQ ID NO: 7473 - protein, 5 aa, Chlamydia trachomatis
SQLEI

SEQ ID NO: 7474 - protein, 5 aa, Chlamydia trachomatis
QLEIN

SEQ ID NO: 7475 - protein, 5 aa, Chlamydia trachomatis
LEINK

SEQ ID NO: 7476 - protein, 5 aa, Chlamydia trachomatis
EINKN

SEQ ID NO: 7477 - protein, 5 aa, Chlamydia trachomatis
INKNS

SEQ ID NO: 7478 - protein, 5 aa, Chlamydia trachomatis
NKNSA

SEQ ID NO: 7479 - protein, 5 aa, Chlamydia trachomatis
KNSAD

SEQ ID NO: 7480 - protein, 5 aa, Chlamydia trachomatis
NSADQ

SEQ ID NO: 7481 - protein, 5 aa, Chlamydia trachomatis
SADQI

SEQ ID NO: 7482 - protein, 5 aa, Chlamydia trachomatis
ADQII

SEQ ID NO: 7483 - protein, 5 aa, Chlamydia trachomatis
DQIIK

SEQ ID NO: 7484 - protein, 5 aa, Chlamydia trachomatis
QIIKD

SEQ ID NO: 7485 - protein, 5 aa, Chlamydia trachomatis
IIKDL

SEQ ID NO: 7486 - protein, 5 aa, Chlamydia trachomatis
IKDLE

SEQ ID NO: 7487 - protein, 5 aa, Chlamydia trachomatis
KDLEG

SEQ ID NO: 7488 - protein, 5 aa, Chlamydia trachomatis
DLEGQ

SEQ ID NO: 7489 - protein, 5 aa, Chlamydia trachomatis
LEGQN

SEQ ID NO: 7490 - protein, 5 aa, Chlamydia trachomatis
EGQNI

SEQ ID NO: 7491 - protein, 5 aa, Chlamydia trachomatis
GQNIS

SEQ ID NO: 7492 - protein, 5 aa, Chlamydia trachomatis
QNISY

SEQ ID NO: 7493 - protein, 5 aa, Chlamydia trachomatis
NISYE

SEQ ID NO: 7494 - protein, 5 aa, Chlamydia trachomatis
ISYEA

SEQ ID NO: 7495 - protein, 5 aa, Chlamydia trachomatis
SYEAV

SEQ ID NO: 7496 - protein, 5 aa, Chlamydia trachomatis
YEAVL

SEQ ID NO: 7497 - protein, 5 aa, Chlamydia trachomatis
EAVLT

SEQ ID NO: 7498 - protein, 5 aa, Chlamydia trachomatis
AVLTN

SEQ ID NO: 7499 - protein, 5 aa, Chlamydia trachomatis
VLTNA

SEQ ID NO: 7500 - protein, 5 aa, Chlamydia trachomatis
LTNAG

SEQ ID NO: 7501 - protein, 5 aa, Chlamydia trachomatis
TNAGE

SEQ ID NO: 7502 - protein, 5 aa, Chlamydia trachomatis
NAGEV

SEQ ID NO: 7503 - protein, 5 aa, Chlamydia trachomatis
AGEVI

SEQ ID NO: 7504 - protein, 5 aa, Chlamydia trachomatis
GEVIK

SEQ ID NO: 7505 - protein, 5 aa, Chlamydia trachomatis
EVIKA

SEQ ID NO: 7506 - protein, 5 aa, Chlamydia trachomatis
VIKAS

SEQ ID NO: 7507 - protein, 5 aa, Chlamydia trachomatis
IKASS

SEQ ID NO: 7508 - protein, 5 aa, Chlamydia trachomatis
KASSE

SEQ ID NO: 7509 - protein, 5 aa, Chlamydia trachomatis
ASSEA

SEQ ID NO: 7510 - protein, 5 aa, Chlamydia trachomatis
SSEAG

SEQ ID NO: 7511 - protein, 5 aa, Chlamydia trachomatis
SEAGI

SEQ ID NO: 7512 - protein, 5 aa, Chlamydia trachomatis
EAGIK

SEQ ID NO: 7513 - protein, 5 aa, Chlamydia trachomatis
AGIKL

SEQ ID NO: 7514 - protein, 5 aa, Chlamydia trachomatis
GIKLG

SEQ ID NO: 7515 - protein, 5 aa, Chlamydia trachomatis
IKLGQ

SEQ ID NO: 7516 - protein, 5 aa, Chlamydia trachomatis
KLGQA

SEQ ID NO: 7517 - protein, 5 aa, Chlamydia trachomatis
LGQAL

SEQ ID NO: 7518 - protein, 5 aa, Chlamydia trachomatis
GQALQ

SEQ ID NO: 7519 - protein, 5 aa, Chlamydia trachomatis
QALQS

SEQ ID NO: 7520 - protein, 5 aa, Chlamydia trachomatis
ALQSI

SEQ ID NO: 7521 - protein, 5 aa, Chlamydia trachomatis
LQSIV

SEQ ID NO: 7522 - protein, 5 aa, Chlamydia trachomatis
QSIVD

SEQ ID NO: 7523 - protein, 5 aa, Chlamydia trachomatis
SIVDA

SEQ ID NO: 7524 - protein, 5 aa, Chlamydia trachomatis
IVDAG

SEQ ID NO: 7525 - protein, 5 aa, Chlamydia trachomatis
VDAGD

SEQ ID NO: 7526 - protein, 5 aa, Chlamydia trachomatis
DAGDQ

SEQ ID NO: 7527 - protein, 5 aa, Chlamydia trachomatis
AGDQS

SEQ ID NO: 7528 - protein, 5 aa, Chlamydia trachomatis
GDQSQ

SEQ ID NO: 7529 - protein, 5 aa, Chlamydia trachomatis
DQSQA

SEQ ID NO: 7530 - protein, 5 aa, Chlamydia trachomatis
QSQAA

SEQ ID NO: 7531 - protein, 5 aa, Chlamydia trachomatis
SQAAV

SEQ ID NO: 7532 - protein, 5 aa, Chlamydia trachomatis
QAAVL

SEQ ID NO: 7533 - protein, 5 aa, Chlamydia trachomatis
AAVLQ

SEQ ID NO: 7534 - protein, 5 aa, Chlamydia trachomatis
AVLQA

SEQ ID NO: 7535 - protein, 5 aa, Chlamydia trachomatis
VLQAQ

SEQ ID NO: 7536 - protein, 5 aa, Chlamydia trachomatis
LQAQQ

SEQ ID NO: 7537 - protein, 5 aa, Chlamydia trachomatis
QAQQN

SEQ ID NO: 7538 - protein, 5 aa, Chlamydia trachomatis
AQQNN

SEQ ID NO: 7539 - protein, 5 aa, Chlamydia trachomatis
QQNNS

SEQ ID NO: 7540 - protein, 5 aa, Chlamydia trachomatis
QNNSP

SEQ ID NO: 7541 - protein, 5 aa, Chlamydia trachomatis
NNSPD

SEQ ID NO: 7542 - protein, 5 aa, Chlamydia trachomatis
NSPDN

SEQ ID NO: 7543 - protein, 5 aa, Chlamydia trachomatis
SPDNI

SEQ ID NO: 7544 - protein, 5 aa, Chlamydia trachomatis
PDNIA

SEQ ID NO: 7545 - protein, 5 aa, Chlamydia trachomatis
DNIAA

SEQ ID NO: 7546 - protein, 5 aa, Chlamydia trachomatis
NIAAT

SEQ ID NO: 7547 - protein, 5 aa, Chlamydia trachomatis
IAATK

SEQ ID NO: 7548 - protein, 5 aa, Chlamydia trachomatis
AATKK

SEQ ID NO: 7549 - protein, 5 aa, Chlamydia trachomatis
ATKKL

SEQ ID NO: 7550 - protein, 5 aa, Chlamydia trachomatis
TKKLI

SEQ ID NO: 7551 - protein, 5 aa, Chlamydia trachomatis
KKLID

SEQ ID NO: 7552 - protein, 5 aa, Chlamydia trachomatis
KLIDA

SEQ ID NO: 7553 - protein, 5 aa, Chlamydia trachomatis
LIDAA

SEQ ID NO: 7554 - protein, 5 aa, Chlamydia trachomatis
IDAAE

SEQ ID NO: 7555 - protein, 5 aa, Chlamydia trachomatis
DAAET

SEQ ID NO: 7556 - protein, 5 aa, Chlamydia trachomatis
AAETK

SEQ ID NO: 7557 - protein, 5 aa, Chlamydia trachomatis
AETKV

SEQ ID NO: 7558 - protein, 5 aa, Chlamydia trachomatis
ETKVN

SEQ ID NO: 7559 - protein, 5 aa, Chlamydia trachomatis
TKVNE

SEQ ID NO: 7560 - protein, 5 aa, Chlamydia trachomatis
KVNEL

SEQ ID NO: 7561 - protein, 5 aa, Chlamydia trachomatis
VNELK

SEQ ID NO: 7562 - protein, 5 aa, Chlamydia trachomatis
NELKQ

SEQ ID NO: 7563 - protein, 5 aa, Chlamydia trachomatis
ELKQE

SEQ ID NO: 7564 - protein, 5 aa, Chlamydia trachomatis
LKQEH

SEQ ID NO: 7565 - protein, 5 aa, Chlamydia trachomatis
KQEHT

SEQ ID NO: 7566 - protein, 5 aa, Chlamydia trachomatis
QEHTG

SEQ ID NO: 7567 - protein, 5 aa, Chlamydia trachomatis
EHTGL

SEQ ID NO: 7568 - protein, 5 aa, Chlamydia trachomatis
HTGLT

SEQ ID NO: 7569 - protein, 5 aa, Chlamydia trachomatis
TGLTD

SEQ ID NO: 7570 - protein, 5 aa, Chlamydia trachomatis
GLTDS

SEQ ID NO: 7571 - protein, 5 aa, Chlamydia trachomatis
LTDSP

SEQ ID NO: 7572 - protein, 5 aa, Chlamydia trachomatis
TDSPL

SEQ ID NO: 7573 - protein, 5 aa, Chlamydia trachomatis
DSPLV

SEQ ID NO: 7574 - protein, 5 aa, Chlamydia trachomatis
SPLVK

SEQ ID NO: 7575 - protein, 5 aa, Chlamydia trachomatis
PLVKK

SEQ ID NO: 7576 - protein, 5 aa, Chlamydia trachomatis
LVKKA

SEQ ID NO: 7577 - protein, 5 aa, Chlamydia trachomatis
VKKAE

SEQ ID NO: 7578 - protein, 5 aa, Chlamydia trachomatis
KKAEE

SEQ ID NO: 7579 - protein, 5 aa, Chlamydia trachomatis
KAEEQ

SEQ ID NO: 7580 - protein, 5 aa, Chlamydia trachomatis
AEEQI

SEQ ID NO: 7581 - protein, 5 aa, Chlamydia trachomatis
EEQIS

SEQ ID NO: 7582 - protein, 5 aa, Chlamydia trachomatis
EQISQ

SEQ ID NO: 7583 - protein, 5 aa, Chlamydia trachomatis
QISQA

SEQ ID NO: 7584 - protein, 5 aa, Chlamydia trachomatis
ISQAQ

SEQ ID NO: 7585 - protein, 5 aa, Chlamydia trachomatis
SQAQK

SEQ ID NO: 7586 - protein, 5 aa, Chlamydia trachomatis
QAQKD

SEQ ID NO: 7587 - protein, 5 aa, Chlamydia trachomatis
AQKDI

SEQ ID NO: 7588 - protein, 5 aa, Chlamydia trachomatis
QKDIQ

SEQ ID NO: 7589 - protein, 5 aa, Chlamydia trachomatis
KDIQE

SEQ ID NO: 7590 - protein, 5 aa, Chlamydia trachomatis
DIQEI

SEQ ID NO: 7591 - protein, 5 aa, Chlamydia trachomatis
IQEIK

SEQ ID NO: 7592 - protein, 5 aa, Chlamydia trachomatis
QEIKP

SEQ ID NO: 7593 - protein, 5 aa, Chlamydia trachomatis
EIKPS

SEQ ID NO: 7594 - protein, 5 aa, Chlamydia trachomatis
IKPSG

SEQ ID NO: 7595 - protein, 5 aa, Chlamydia trachomatis
KPSGS

SEQ ID NO: 7596 - protein, 5 aa, Chlamydia trachomatis
PSGSD

SEQ ID NO: 7597 - protein, 5 aa, Chlamydia trachomatis
SGSDI

SEQ ID NO: 7598 - protein, 5 aa, Chlamydia trachomatis
GSDIP

SEQ ID NO: 7599 - protein, 5 aa, Chlamydia trachomatis
SDIPI

SEQ ID NO: 7600 - protein, 5 aa, Chlamydia trachomatis
DIPIV

SEQ ID NO: 7601 - protein, 5 aa, Chlamydia trachomatis
IPIVG

SEQ ID NO: 7602 - protein, 5 aa, Chlamydia trachomatis
PIVGP

SEQ ID NO: 7603 - protein, 5 aa, Chlamydia trachomatis
IVGPS

SEQ ID NO: 7604 - protein, 5 aa, Chlamydia trachomatis
VGPSG

SEQ ID NO: 7605 - protein, 5 aa, Chlamydia trachomatis
GPSGS

SEQ ID NO: 7606 - protein, 5 aa, Chlamydia trachomatis
PSGSA

SEQ ID NO: 7607 - protein, 5 aa, Chlamydia trachomatis
SGSAA

SEQ ID NO: 7608 - protein, 5 aa, Chlamydia trachomatis
GSAAS

SEQ ID NO: 7609 - protein, 5 aa, Chlamydia trachomatis
SAASA

SEQ ID NO: 7610 - protein, 5 aa, Chlamydia trachomatis
AASAG

SEQ ID NO: 7611 - protein, 5 aa, Chlamydia trachomatis
ASAGS

SEQ ID NO: 7612 - protein, 5 aa, Chlamydia trachomatis
SAGSA

SEQ ID NO: 7613 - protein, 5 aa, Chlamydia trachomatis
AGSAV

SEQ ID NO: 7614 - protein, 5 aa, Chlamydia trachomatis
GSAVG

SEQ ID NO: 7615 - protein, 5 aa, Chlamydia trachomatis
SAVGA

SEQ ID NO: 7616 - protein, 5 aa, Chlamydia trachomatis
AVGAL

SEQ ID NO: 7617 - protein, 5 aa, Chlamydia trachomatis
VGALK

SEQ ID NO: 7618 - protein, 5 aa, Chlamydia trachomatis
GALKS

SEQ ID NO: 7619 - protein, 5 aa, Chlamydia trachomatis
ALKSS

SEQ ID NO: 7620 - protein, 5 aa, Chlamydia trachomatis
LKSSN

SEQ ID NO: 7621 - protein, 5 aa, Chlamydia trachomatis
KSSNN

SEQ ID NO: 7622 - protein, 5 aa, Chlamydia trachomatis
SSNNS

SEQ ID NO: 7623 - protein, 5 aa, Chlamydia trachomatis
SNNSG

SEQ ID NO: 7624 - protein, 5 aa, Chlamydia trachomatis
NNSGR

SEQ ID NO: 7625 - protein, 5 aa, Chlamydia trachomatis
NSGRI

SEQ ID NO: 7626 - protein, 5 aa, Chlamydia trachomatis
SGRIS

SEQ ID NO: 7627 - protein, 5 aa, Chlamydia trachomatis
GRISL

SEQ ID NO: 7628 - protein, 5 aa, Chlamydia trachomatis
RISLL

SEQ ID NO: 7629 - protein, 5 aa, Chlamydia trachomatis
ISLLL

SEQ ID NO: 7630 - protein, 5 aa, Chlamydia trachomatis
SLLLD

SEQ ID NO: 7631 - protein, 5 aa, Chlamydia trachomatis
LLLDD

SEQ ID NO: 7632 - protein, 5 aa, Chlamydia trachomatis
LLDDV

SEQ ID NO: 7633 - protein, 5 aa, Chlamydia trachomatis
LDDVD

SEQ ID NO: 7634 - protein, 5 aa, Chlamydia trachomatis
DDVDN

SEQ ID NO: 7635 - protein, 5 aa, Chlamydia trachomatis
DVDNE

SEQ ID NO: 7636 - protein, 5 aa, Chlamydia trachomatis
VDNEM

SEQ ID NO: 7637 - protein, 5 aa, Chlamydia trachomatis
DNEMA

SEQ ID NO: 7638 - protein, 5 aa, Chlamydia trachomatis
NEMAA

SEQ ID NO: 7639 - protein, 5 aa, Chlamydia trachomatis
EMAAI

SEQ ID NO: 7640 - protein, 5 aa, Chlamydia trachomatis
MAAIA

SEQ ID NO: 7641 - protein, 5 aa, Chlamydia trachomatis
AAIAM

SEQ ID NO: 7642 - protein, 5 aa, Chlamydia trachomatis
AIAMQ

SEQ ID NO: 7643 - protein, 5 aa, Chlamydia trachomatis
IAMQG

SEQ ID NO: 7644 - protein, 5 aa, Chlamydia trachomatis
AMQGF

SEQ ID NO: 7645 - protein, 5 aa, Chlamydia trachomatis
MQGFR

SEQ ID NO: 7646 - protein, 5 aa, Chlamydia trachomatis
QGFRS

SEQ ID NO: 7647 - protein, 5 aa, Chlamydia trachomatis
GFRSM

SEQ ID NO: 7648 - protein, 5 aa, Chlamydia trachomatis
FRSMI

SEQ ID NO: 7649 - protein, 5 aa, Chlamydia trachomatis
RSMIE

SEQ ID NO: 7650 - protein, 5 aa, Chlamydia trachomatis
SMIEQ

SEQ ID NO: 7651 - protein, 5 aa, Chlamydia trachomatis
MIEQF

SEQ ID NO: 7652 - protein, 5 aa, Chlamydia trachomatis
IEQFN

SEQ ID NO: 7653 - protein, 5 aa, Chlamydia trachomatis
EQFNV

SEQ ID NO: 7654 - protein, 5 aa, Chlamydia trachomatis
QFNVN

SEQ ID NO: 7655 - protein, 5 aa, Chlamydia trachomatis
FNVNN

SEQ ID NO: 7656 - protein, 5 aa, Chlamydia trachomatis
NVNNP

SEQ ID NO: 7657 - protein, 5 aa, Chlamydia trachomatis
VNNPA

SEQ ID NO: 7658 - protein, 5 aa, Chlamydia trachomatis
NNPAT

SEQ ID NO: 7659 - protein, 5 aa, Chlamydia trachomatis
NPATA

SEQ ID NO: 7660 - protein, 5 aa, Chlamydia trachomatis
PATAK

SEQ ID NO: 7661 - protein, 5 aa, Chlamydia trachomatis
ATAKE

SEQ ID NO: 7662 - protein, 5 aa, Chlamydia trachomatis
TAKEL

SEQ ID NO: 7663 - protein, 5 aa, Chlamydia trachomatis
AKELQ

SEQ ID NO: 7664 - protein, 5 aa, Chlamydia trachomatis
KELQA

SEQ ID NO: 7665 - protein, 5 aa, Chlamydia trachomatis
ELQAM

SEQ ID NO: 7666 - protein, 5 aa, Chlamydia trachomatis
LQAME

SEQ ID NO: 7667 - protein, 5 aa, Chlamydia trachomatis
QAMEA

SEQ ID NO: 7668 - protein, 5 aa, Chlamydia trachomatis
AMEAQ

SEQ ID NO: 7669 - protein, 5 aa, Chlamydia trachomatis
MEAQL

SEQ ID NO: 7670 - protein, 5 aa, Chlamydia trachomatis
EAQLT

SEQ ID NO: 7671 - protein, 5 aa, Chlamydia trachomatis
AQLTA

SEQ ID NO: 7672 - protein, 5 aa, Chlamydia trachomatis
QLTAM

SEQ ID NO: 7673 - protein, 5 aa, Chlamydia trachomatis
LTAMS

SEQ ID NO: 7674 - protein, 5 aa, Chlamydia trachomatis
TAMSD

SEQ ID NO: 7675 - protein, 5 aa, Chlamydia trachomatis
AMSDQ

SEQ ID NO: 7676 - protein, 5 aa, Chlamydia trachomatis
MSDQL

SEQ ID NO: 7677 - protein, 5 aa, Chlamydia trachomatis
SDQLV

SEQ ID NO: 7678 - protein, 5 aa, Chlamydia trachomatis
DQLVG

SEQ ID NO: 7679 - protein, 5 aa, Chlamydia trachomatis
QLVGA

SEQ ID NO: 7680 - protein, 5 aa, Chlamydia trachomatis
LVGAD

SEQ ID NO: 7681 - protein, 5 aa, Chlamydia trachomatis
VGADG

SEQ ID NO: 7682 - protein, 5 aa, Chlamydia trachomatis
GADGE

SEQ ID NO: 7683 - protein, 5 aa, Chlamydia trachomatis
ADGEL

SEQ ID NO: 7684 - protein, 5 aa, Chlamydia trachomatis
DGELP

SEQ ID NO: 7685 - protein, 5 aa, Chlamydia trachomatis
GELPA

SEQ ID NO: 7686 - protein, 5 aa, Chlamydia trachomatis
ELPAE

SEQ ID NO: 7687 - protein, 5 aa, Chlamydia trachomatis
LPAEI

SEQ ID NO: 7688 - protein, 5 aa, Chlamydia trachomatis
PAEIQ

SEQ ID NO: 7689 - protein, 5 aa, Chlamydia trachomatis
AEIQA

SEQ ID NO: 7690 - protein, 5 aa, Chlamydia trachomatis
EIQAI

SEQ ID NO: 7691 - protein, 5 aa, Chlamydia trachomatis
IQAIK

SEQ ID NO: 7692 - protein, 5 aa, Chlamydia trachomatis
QAIKD

SEQ ID NO: 7693 - protein, 5 aa, Chlamydia trachomatis
AIKDA

SEQ ID NO: 7694 - protein, 5 aa, Chlamydia trachomatis
IKDAL

SEQ ID NO: 7695 - protein, 5 aa, Chlamydia trachomatis
KDALA

SEQ ID NO: 7696 - protein, 5 aa, Chlamydia trachomatis
DALAQ

SEQ ID NO: 7697 - protein, 5 aa, Chlamydia trachomatis
ALAQA

SEQ ID NO: 7698 - protein, 5 aa, Chlamydia trachomatis
LAQAL

SEQ ID NO: 7699 - protein, 5 aa, Chlamydia trachomatis
AQALK

SEQ ID NO: 7700 - protein, 5 aa, Chlamydia trachomatis
QALKQ

SEQ ID NO: 7701 - protein, 5 aa, Chlamydia trachomatis
ALKQP

SEQ ID NO: 7702 - protein, 5 aa, Chlamydia trachomatis
LKQPS

SEQ ID NO: 7703 - protein, 5 aa, Chlamydia trachomatis
KQPST

SEQ ID NO: 7704 - protein, 5 aa, Chlamydia trachomatis
QPSTD

SEQ ID NO: 7705 - protein, 5 aa, Chlamydia trachomatis
PSTDG

SEQ ID NO: 7706 - protein, 5 aa, Chlamydia trachomatis
STDGL

SEQ ID NO: 7707 - protein, 5 aa, Chlamydia trachomatis
TDGLA

SEQ ID NO: 7708 - protein, 5 aa, Chlamydia trachomatis
DGLAT

SEQ ID NO: 7709 - protein, 5 aa, Chlamydia trachomatis
GLATA

SEQ ID NO: 7710 - protein, 5 aa, Chlamydia trachomatis
LATAM

SEQ ID NO: 7711 - protein, 5 aa, Chlamydia trachomatis
ATAMG

SEQ ID NO: 7712 - protein, 5 aa, Chlamydia trachomatis
TAMGQ

SEQ ID NO: 7713 - protein, 5 aa, Chlamydia trachomatis
AMGQV

SEQ ID NO: 7714 - protein, 5 aa, Chlamydia trachomatis
MGQVA

SEQ ID NO: 7715 - protein, 5 aa, Chlamydia trachomatis
GQVAF

SEQ ID NO: 7716 - protein, 5 aa, Chlamydia trachomatis
QVAFA

SEQ ID NO: 7717 - protein, 5 aa, Chlamydia trachomatis
VAFAA

SEQ ID NO: 7718 - protein, 5 aa, Chlamydia trachomatis
AFAAA

SEQ ID NO: 7719 - protein, 5 aa, Chlamydia trachomatis
FAAAK

SEQ ID NO: 7720 - protein, 5 aa, Chlamydia trachomatis
AAAKV

SEQ ID NO: 7721 - protein, 5 aa, Chlamydia trachomatis
AAKVG

SEQ ID NO: 7722 - protein, 5 aa, Chlamydia trachomatis
AKVGG

SEQ ID NO: 7723 - protein, 5 aa, Chlamydia trachomatis
KVGGG

SEQ ID NO: 7724 - protein, 5 aa, Chlamydia trachomatis
VGGGS

SEQ ID NO: 7725 - protein, 5 aa, Chlamydia trachomatis
GGGSA

SEQ ID NO: 7726 - protein, 5 aa, Chlamydia trachomatis
GGSAG

SEQ ID NO: 7727 - protein, 5 aa, Chlamydia trachomatis
GSAGT

SEQ ID NO: 7728 - protein, 5 aa, Chlamydia trachomatis
SAGTA

SEQ ID NO: 7729 - protein, 5 aa, Chlamydia trachomatis
AGTAG

SEQ ID NO: 7730 - protein, 5 aa, Chlamydia trachomatis
GTAGT

SEQ ID NO: 7731 - protein, 5 aa, Chlamydia trachomatis
TAGTV

SEQ ID NO: 7732 - protein, 5 aa, Chlamydia trachomatis
AGTVQ

SEQ ID NO: 7733 - protein, 5 aa, Chlamydia trachomatis
GTVQM

SEQ ID NO: 7734 - protein, 5 aa, Chlamydia trachomatis
TVQMN

SEQ ID NO: 7735 - protein, 5 aa, Chlamydia trachomatis
VQMNV

SEQ ID NO: 7736 - protein, 5 aa, Chlamydia trachomatis
QMNVK

SEQ ID NO: 7737 - protein, 5 aa, Chlamydia trachomatis
MNVKQ

SEQ ID NO: 7738 - protein, 5 aa, Chlamydia trachomatis
NVKQL

SEQ ID NO: 7739 - protein, 5 aa, Chlamydia trachomatis
VKQLY

SEQ ID NO: 7740 - protein, 5 aa, Chlamydia trachomatis
KQLYK

SEQ ID NO: 7741 - protein, 5 aa, Chlamydia trachomatis
QLYKT

SEQ ID NO: 7742 - protein, 5 aa, Chlamydia trachomatis
LYKTA

SEQ ID NO: 7743 - protein, 5 aa, Chlamydia trachomatis
YKTAF

SEQ ID NO: 7744 - protein, 5 aa, Chlamydia trachomatis
KTAFS

SEQ ID NO: 7745 - protein, 5 aa, Chlamydia trachomatis
TAFSS

SEQ ID NO: 7746 - protein, 5 aa, Chlamydia trachomatis
AFSST

SEQ ID NO: 7747 - protein, 5 aa, Chlamydia trachomatis
FSSTS

SEQ ID NO: 7748 - protein, 5 aa, Chlamydia trachomatis
SSTSS

SEQ ID NO: 7749 - protein, 5 aa, Chlamydia trachomatis
STSSS

SEQ ID NO: 7750 - protein, 5 aa, Chlamydia trachomatis
TSSSS

SEQ ID NO: 7751 - protein, 5 aa, Chlamydia trachomatis
SSSSY

SEQ ID NO: 7752 - protein, 5 aa, Chlamydia trachomatis
SSSYA

SEQ ID NO: 7753 - protein, 5 aa, Chlamydia trachomatis
SSYAA

SEQ ID NO: 7754 - protein, 5 aa, Chlamydia trachomatis
SYAAA

SEQ ID NO: 7755 - protein, 5 aa, Chlamydia trachomatis
YAAAL

SEQ ID NO: 7756 - protein, 5 aa, Chlamydia trachomatis
AAALS

SEQ ID NO: 7757 - protein, 5 aa, Chlamydia trachomatis
AALSD

SEQ ID NO: 7758 - protein, 5 aa, Chlamydia trachomatis
ALSDG

SEQ ID NO: 7759 - protein, 5 aa, Chlamydia trachomatis
LSDGY

SEQ ID NO: 7760 - protein, 5 aa, Chlamydia trachomatis
SDGYS

SEQ ID NO: 7761 - protein, 5 aa, Chlamydia trachomatis
DGYSA

SEQ ID NO: 7762 - protein, 5 aa, Chlamydia trachomatis
GYSAY

SEQ ID NO: 7763 - protein, 5 aa, Chlamydia trachomatis
YSAYK

SEQ ID NO: 7764 - protein, 5 aa, Chlamydia trachomatis
SAYKT

SEQ ID NO: 7765 - protein, 5 aa, Chlamydia trachomatis
AYKTL

SEQ ID NO: 7766 - protein, 5 aa, Chlamydia trachomatis
YKTLN

SEQ ID NO: 7767 - protein, 5 aa, Chlamydia trachomatis
KTLNS

SEQ ID NO: 7768 - protein, 5 aa, Chlamydia trachomatis
TLNSL

SEQ ID NO: 7769 - protein, 5 aa, Chlamydia trachomatis
LNSLY

SEQ ID NO: 7770 - protein, 5 aa, Chlamydia trachomatis
NSLYS

SEQ ID NO: 7771 - protein, 5 aa, Chlamydia trachomatis
SLYSE

SEQ ID NO: 7772 - protein, 5 aa, Chlamydia trachomatis
LYSES

SEQ ID NO: 7773 - protein, 5 aa, Chlamydia trachomatis
YSESR

SEQ ID NO: 7774 - protein, 5 aa, Chlamydia trachomatis
SESRS

SEQ ID NO: 7775 - protein, 5 aa, Chlamydia trachomatis
ESRSG

SEQ ID NO: 7776 - protein, 5 aa, Chlamydia trachomatis
SRSGV

SEQ ID NO: 7777 - protein, 5 aa, Chlamydia trachomatis
RSGVQ

SEQ ID NO: 7778 - protein, 5 aa, Chlamydia trachomatis
SGVQS

SEQ ID NO: 7779 - protein, 5 aa, Chlamydia trachomatis
GVQSA

SEQ ID NO: 7780 - protein, 5 aa, Chlamydia trachomatis
VQSAI

SEQ ID NO: 7781 - protein, 5 aa, Chlamydia trachomatis
QSAIS

SEQ ID NO: 7782 - protein, 5 aa, Chlamydia trachomatis
SAISQ

SEQ ID NO: 7783 - protein, 5 aa, Chlamydia trachomatis
AISQT

SEQ ID NO: 7784 - protein, 5 aa, Chlamydia trachomatis
ISQTA

SEQ ID NO: 7785 - protein, 5 aa, Chlamydia trachomatis
SQTAN

SEQ ID NO: 7786 - protein, 5 aa, Chlamydia trachomatis
QTANP

SEQ ID NO: 7787 - protein, 5 aa, Chlamydia trachomatis
TANPA

SEQ ID NO: 7788 - protein, 5 aa, Chlamydia trachomatis
ANPAL

SEQ ID NO: 7789 - protein, 5 aa, Chlamydia trachomatis
NPALS

SEQ ID NO: 7790 - protein, 5 aa, Chlamydia trachomatis
PALSR

SEQ ID NO: 7791 - protein, 5 aa, Chlamydia trachomatis
ALSRS

SEQ ID NO: 7792 - protein, 5 aa, Chlamydia trachomatis
LSRSV

SEQ ID NO: 7793 - protein, 5 aa, Chlamydia trachomatis
SRSVS

SEQ ID NO: 7794 - protein, 5 aa, Chlamydia trachomatis
RSVSR

SEQ ID NO: 7795 - protein, 5 aa, Chlamydia trachomatis
SVSRS

SEQ ID NO: 7796 - protein, 5 aa, Chlamydia trachomatis
VSRSG

SEQ ID NO: 7797 - protein, 5 aa, Chlamydia trachomatis
SRSGI

SEQ ID NO: 7798 - protein, 5 aa, Chlamydia trachomatis
RSGIE

SEQ ID NO: 7799 - protein, 5 aa, Chlamydia trachomatis
SGIES

SEQ ID NO: 7800 - protein, 5 aa, Chlamydia trachomatis
GIESQ

SEQ ID NO: 7801 - protein, 5 aa, Chlamydia trachomatis
IESQG

SEQ ID NO: 7802 - protein, 5 aa, Chlamydia trachomatis
ESQGR

SEQ ID NO: 7803 - protein, 5 aa, Chlamydia trachomatis
SQGRS

SEQ ID NO: 7804 - protein, 5 aa, Chlamydia trachomatis
QGRSA

SEQ ID NO: 7805 - protein, 5 aa, Chlamydia trachomatis
GRSAD

SEQ ID NO: 7806 - protein, 5 aa, Chlamydia trachomatis
RSADA

SEQ ID NO: 7807 - protein, 5 aa, Chlamydia trachomatis
SADAS

SEQ ID NO: 7808 - protein, 5 aa, Chlamydia trachomatis
ADASQ

SEQ ID NO: 7809 - protein, 5 aa, Chlamydia trachomatis
DASQR

SEQ ID NO: 7810 - protein, 5 aa, Chlamydia trachomatis
ASQRA

SEQ ID NO: 7811 - protein, 5 aa, Chlamydia trachomatis
SQRAA

SEQ ID NO: 7812 - protein, 5 aa, Chlamydia trachomatis
QRAAE

SEQ ID NO: 7813 - protein, 5 aa, Chlamydia trachomatis
RAAET

SEQ ID NO: 7814 - protein, 5 aa, Chlamydia trachomatis
AAETI

SEQ ID NO: 7815 - protein, 5 aa, Chlamydia trachomatis
AETIV

SEQ ID NO: 7816 - protein, 5 aa, Chlamydia trachomatis
ETIVR

SEQ ID NO: 7817 - protein, 5 aa, Chlamydia trachomatis
TIVRD

SEQ ID NO: 7818 - protein, 5 aa, Chlamydia trachomatis
IVRDS

SEQ ID NO: 7819 - protein, 5 aa, Chlamydia trachomatis
VRDSQ

SEQ ID NO: 7820 - protein, 5 aa, Chlamydia trachomatis
RDSQT

SEQ ID NO: 7821 - protein, 5 aa, Chlamydia trachomatis
DSQTL

SEQ ID NO: 7822 - protein, 5 aa, Chlamydia trachomatis
SQTLG

SEQ ID NO: 7823 - protein, 5 aa, Chlamydia trachomatis
QTLGD

SEQ ID NO: 7824 - protein, 5 aa, Chlamydia trachomatis
TLGDV

SEQ ID NO: 7825 - protein, 5 aa, Chlamydia trachomatis
LGDVY

SEQ ID NO: 7826 - protein, 5 aa, Chlamydia trachomatis
GDVYS

SEQ ID NO: 7827 - protein, 5 aa, Chlamydia trachomatis
DVYSR

SEQ ID NO: 7828 - protein, 5 aa, Chlamydia trachomatis
VYSRL

SEQ ID NO: 7829 - protein, 5 aa, Chlamydia trachomatis
YSRLQ

SEQ ID NO: 7830 - protein, 5 aa, Chlamydia trachomatis
SRLQV

SEQ ID NO: 7831 - protein, 5 aa, Chlamydia trachomatis
RLQVL

SEQ ID NO: 7832 - protein, 5 aa, Chlamydia trachomatis
LQVLD

SEQ ID NO: 7833 - protein, 5 aa, Chlamydia trachomatis
QVLDS

SEQ ID NO: 7834 - protein, 5 aa, Chlamydia trachomatis
VLDSL

SEQ ID NO: 7835 - protein, 5 aa, Chlamydia trachomatis
LDSLM

SEQ ID NO: 7836 - protein, 5 aa, Chlamydia trachomatis
DSLMS

SEQ ID NO: 7837 - protein, 5 aa, Chlamydia trachomatis
SLMST

SEQ ID NO: 7838 - protein, 5 aa, Chlamydia trachomatis
LMSTI

SEQ ID NO: 7839 - protein, 5 aa, Chlamydia trachomatis
MSTIV

SEQ ID NO: 7840 - protein, 5 aa, Chlamydia trachomatis
STIVS

SEQ ID NO: 7841 - protein, 5 aa, Chlamydia trachomatis
TIVSN

SEQ ID NO: 7842 - protein, 5 aa, Chlamydia trachomatis
IVSNP

SEQ ID NO: 7843 - protein, 5 aa, Chlamydia trachomatis
VSNPQ

SEQ ID NO: 7844 - protein, 5 aa, Chlamydia trachomatis
SNPQV

SEQ ID NO: 7845 - protein, 5 aa, Chlamydia trachomatis
NPQVN

SEQ ID NO: 7846 - protein, 5 aa, Chlamydia trachomatis
PQVNQ

SEQ ID NO: 7847 - protein, 5 aa, Chlamydia trachomatis
QVNQE

SEQ ID NO: 7848 - protein, 5 aa, Chlamydia trachomatis
VNQEE

SEQ ID NO: 7849 - protein, 5 aa, Chlamydia trachomatis
NQEEI

SEQ ID NO: 7850 - protein, 5 aa, Chlamydia trachomatis
QEEIM

SEQ ID NO: 7851 - protein, 5 aa, Chlamydia trachomatis
EEIMQ

SEQ ID NO: 7852 - protein, 5 aa, Chlamydia trachomatis
EIMQK

SEQ ID NO: 7853 - protein, 5 aa, Chlamydia trachomatis
IMQKL

SEQ ID NO: 7854 - protein, 5 aa, Chlamydia trachomatis
MQKLT

SEQ ID NO: 7855 - protein, 5 aa, Chlamydia trachomatis
QKLTA

SEQ ID NO: 7856 - protein, 5 aa, Chlamydia trachomatis
KLTAS

SEQ ID NO: 7857 - protein, 5 aa, Chlamydia trachomatis
LTASI

SEQ ID NO: 7858 - protein, 5 aa, Chlamydia trachomatis
TASIS

SEQ ID NO: 7859 - protein, 5 aa, Chlamydia trachomatis
ASISK

SEQ ID NO: 7860 - protein, 5 aa, Chlamydia trachomatis
SISKA

SEQ ID NO: 7861 - protein, 5 aa, Chlamydia trachomatis
ISKAP

SEQ ID NO: 7862 - protein, 5 aa, Chlamydia trachomatis
SKAPQ

SEQ ID NO: 7863 - protein, 5 aa, Chlamydia trachomatis
KAPQF

SEQ ID NO: 7864 - protein, 5 aa, Chlamydia trachomatis
APQFG

SEQ ID NO: 7865 - protein, 5 aa, Chlamydia trachomatis
PQFGY

SEQ ID NO: 7866 - protein, 5 aa, Chlamydia trachomatis
QFGYP

SEQ ID NO: 7867 - protein, 5 aa, Chlamydia trachomatis
FGYPA

SEQ ID NO: 7868 - protein, 5 aa, Chlamydia trachomatis
GYPAV

SEQ ID NO: 7869 - protein, 5 aa, Chlamydia trachomatis
YPAVQ

SEQ ID NO: 7870 - protein, 5 aa, Chlamydia trachomatis
PAVQN

SEQ ID NO: 7871 - protein, 5 aa, Chlamydia trachomatis
AVQNS

SEQ ID NO: 7872 - protein, 5 aa, Chlamydia trachomatis
VQNSA

SEQ ID NO: 7873 - protein, 5 aa, Chlamydia trachomatis
QNSAD

SEQ ID NO: 7874 - protein, 5 aa, Chlamydia trachomatis
NSADS

SEQ ID NO: 7875 - protein, 5 aa, Chlamydia trachomatis
SADSL

SEQ ID NO: 7876 - protein, 5 aa, Chlamydia trachomatis
ADSLQ

SEQ ID NO: 7877 - protein, 5 aa, Chlamydia trachomatis
DSLQK

SEQ ID NO: 7878 - protein, 5 aa, Chlamydia trachomatis
SLQKF

SEQ ID NO: 7879 - protein, 5 aa, Chlamydia trachomatis
LQKFA

SEQ ID NO: 7880 - protein, 5 aa, Chlamydia trachomatis
QKFAA

SEQ ID NO: 7881 - protein, 5 aa, Chlamydia trachomatis
KFAAQ

SEQ ID NO: 7882 - protein, 5 aa, Chlamydia trachomatis
FAAQL

SEQ ID NO: 7883 - protein, 5 aa, Chlamydia trachomatis
AAQLE

SEQ ID NO: 7884 - protein, 5 aa, Chlamydia trachomatis
AQLER

SEQ ID NO: 7885 - protein, 5 aa, Chlamydia trachomatis
QLERE

SEQ ID NO: 7886 - protein, 5 aa, Chlamydia trachomatis
LEREF

SEQ ID NO: 7887 - protein, 5 aa, Chlamydia trachomatis
EREFV

SEQ ID NO: 7888 - protein, 5 aa, Chlamydia trachomatis
REFVD

SEQ ID NO: 7889 - protein, 5 aa, Chlamydia trachomatis
EFVDG

SEQ ID NO: 7890 - protein, 5 aa, Chlamydia trachomatis
FVDGE

SEQ ID NO: 7891 - protein, 5 aa, Chlamydia trachomatis
VDGER

SEQ ID NO: 7892 - protein, 5 aa, Chlamydia trachomatis
DGERS

SEQ ID NO: 7893 - protein, 5 aa, Chlamydia trachomatis
GERSL

SEQ ID NO: 7894 - protein, 5 aa, Chlamydia trachomatis
ERSLA

SEQ ID NO: 7895 - protein, 5 aa, Chlamydia trachomatis
RSLAE

SEQ ID NO: 7896 - protein, 5 aa, Chlamydia trachomatis
SLAES

SEQ ID NO: 7897 - protein, 5 aa, Chlamydia trachomatis
LAESR

SEQ ID NO: 7898 - protein, 5 aa, Chlamydia trachomatis
AESRE

SEQ ID NO: 7899 - protein, 5 aa, Chlamydia trachomatis
ESREN

SEQ ID NO: 7900 - protein, 5 aa, Chlamydia trachomatis
SRENA

SEQ ID NO: 7901 - protein, 5 aa, Chlamydia trachomatis
RENAF

SEQ ID NO: 7902 - protein, 5 aa, Chlamydia trachomatis
ENAFR

SEQ ID NO: 7903 - protein, 5 aa, Chlamydia trachomatis
NAFRK

SEQ ID NO: 7904 - protein, 5 aa, Chlamydia trachomatis
AFRKQ

SEQ ID NO: 7905 - protein, 5 aa, Chlamydia trachomatis
FRKQP

SEQ ID NO: 7906 - protein, 5 aa, Chlamydia trachomatis
RKQPA

SEQ ID NO: 7907 - protein, 5 aa, Chlamydia trachomatis
KQPAF

SEQ ID NO: 7908 - protein, 5 aa, Chlamydia trachomatis
QPAFI

SEQ ID NO: 7909 - protein, 5 aa, Chlamydia trachomatis
PAFIQ

SEQ ID NO: 7910 - protein, 5 aa, Chlamydia trachomatis
AFIQQ

SEQ ID NO: 7911 - protein, 5 aa, Chlamydia trachomatis
FIQQV

SEQ ID NO: 7912 - protein, 5 aa, Chlamydia trachomatis
IQQVL

SEQ ID NO: 7913 - protein, 5 aa, Chlamydia trachomatis
QQVLV

SEQ ID NO: 7914 - protein, 5 aa, Chlamydia trachomatis
QVLVN

SEQ ID NO: 7915 - protein, 5 aa, Chlamydia trachomatis
VLVNI

SEQ ID NO: 7916 - protein, 5 aa, Chlamydia trachomatis
LVNIA

SEQ ID NO: 7917 - protein, 5 aa, Chlamydia trachomatis
VNIAS

SEQ ID NO: 7918 - protein, 5 aa, Chlamydia trachomatis
NIASL

SEQ ID NO: 7919 - protein, 5 aa, Chlamydia trachomatis
IASLF

SEQ ID NO: 7920 - protein, 5 aa, Chlamydia trachomatis
ASLFS

SEQ ID NO: 7921 - protein, 5 aa, Chlamydia trachomatis
SLFSG

SEQ ID NO: 7922 - protein, 5 aa, Chlamydia trachomatis
LFSGY

SEQ ID NO: 7923 - protein, 5 aa, Chlamydia trachomatis
FSGYL

SEQ ID NO: 7924 - protein, 5 aa, Chlamydia trachomatis
SGYLS

SEQ ID NO: 7925 - protein, 553 aa, Chlamydia trachomatis
MRIGDPMNKLIRRAVTIFAVTSVASLFASGVLETSMAESLSTNVISLADTKAKDNTSHKSKKARKNHSKETPVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINIVNQGTATARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 7926 - protein, 257 aa, Chlamydia trachomatis
MCIKRKKTWIAFLAVVCSFCLTGCLKEGGDSNSEKFIVGTNATYPPFEFVDKRGEVVGFDIDLAREISNKLGKTLDVREFSFDALILNLKQHRIDAVITGMSITPSRLKEILMIPYYGEEIKHLVLVFKGENKHPLPLTQYRSVAVQTGTYQEAYLQSLSEVHIRSFDSTLEVLMEVMHGKSPVAVLEPSIAQVVLKDFPALSTATIDLPEDQWVLGYGIGVASDRPALALKIEAAVQEIRKEGVLAELEQKWGLNN

SEQ ID NO: 7927 - protein, 591 aa, Chlamydia trachomatis
MSIRGVGGNGNSRIPSHNGDGSNRRSQNTKGNNKVEDRVCSLYSSRSNENRESPYAVVDVSSMIESTPTSGETTRASRGVFSRFQRGLVRVADKVRRAVQCAWSSVSTRRSSATRAAESGSSSRTARGASSGYREYSPSAARGLRLMFTDFWRTRVLRQTSPMAGVFGNLDVNEARLMAAYTSECADHLEANKLAGPDGVAAAREIAKRWEQRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRAQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMDMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMRRWNREVDRE

SEQ ID NO: 7928 - protein, 1449 aa, Chlamydia trachomatis
MANPSTPSFNHSDLSLQGRLRASSQQCTQAGQGDPQPLSPESRGLTSNFSTRRDLIDVVEESIETAKGSELKKLRIYEIALKILTIIGAAILFAVPLCMLLGVPLWIPIVTCIGVGIAFSIAKGCLQKRCQQIREEYRALHLYHRYLLSNKDSIDGTLLSRFDIRFRKAEEKLHGLDLDKREANHPLEADKRYDFAGLAHQRYQVDAALGISSSQDAFWRGVAQQVKSVKDDVVLGDKASTDLYPIAQQALQAAGVGFSGAAGKESLLDLAKSLSSLFAWGSQVGKDSHEALQQYQMRFLSSPILATWCGAGFSASAQDFVLKGENILDIASENHTKMQNAIKRVQLVSVLGKMRNWKEKIDTLIQNKNLDQDSLRKLYQDIEKAMHKVCIEDGVSTSIQTQVRKVTQKYLRQDLQELLNKKAPLNESDLSKMQKGISSCANLVVTLLESQLGTSGQTPIKEVEESIYRDLIATILQMGSAAGGVTPLVDGVHKAIREGKALRSELSRAMSLHPRQSFLGVQSAVEKLQAFIRDPKWGASAVHTSAEETLAQKQKFVSDLTRIQTSLADWRERYGLFEETKLNHIVSTDFVSRTEAFLDTLKNVAEACSLEQAVAELKDCEDAMKADLTHVEQKMNPTEIESAREEFKRLMEELAGIQEQLEQIAQPIYEEGVSGERLLLNTVFFHPEVLRKKVQAKEASLEALTKGEQPSPTKKKTLKQLSEGCEYFSSLVSKINALKTILEGSRGKKIASQDIRQLIGLTDELALELSSFQQDSLESLLYGLEGLSIPAASIEQKKGSPKSSSIAEKVVYASHQRVHNGVKAKVNRTLEAFSQLIKGLRGSLRNAMITKAVVAAVLSVAFSCLAIALFSVQLTWLPIMLCVLALVLEAIPSALSIWVEKRNWKYEVASLAKQLVSDGRKLPYPDLGDQNIKHLEKIRDVYGLDGVAELRVAEAALLGVQKLPEEQKQESLKSAVKALRADAKVLNKKFKKLPESYQPQHSEVTGVQGVTEQESRDDVLVAQDMAAIEELQDQYHAACLQFESVSTRFLAEQRKAKFLEELLVQKRRDVSHLSHQEAHYTQVVSHLKELISMRKGASTQHASKEEISTKMRELLSLDDQLLKAHTAQDVNRDNSINGQLQQQFKKLSEEGSLQKVKALLELNMCLGNAGQTLYHSRLKREVFEASLSGTSRQLLQYGEDLFASYDGSDRSALLRFVLGSGYEMISEASSELKSLRKRWKRSASQAAIAPEDYEKVCRVLERFLKARDSLRPKLGLPLGKSSDATVGLQHQIRDNQRVKARVTACYQESCRNVLQHLEDWVRKTRQESAECQKVETKIREFCQKAGSKENLAESTEMLFSSLEEDLNKIPLDVLRAILRSLSSKVLHIRDQKLELEKLEEQFAKTNAIVKAKEAEFEKNGEVWHNQYQMLKSQMEKLESQKRRLTDKKE

SEQ ID NO: 7929 - protein, 544 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIRKISKPVQHHKEIAQVATISANNDAEIGNLIAEAMEKVGKNGSITVEEAKGFETVLDVVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENANLAMLGKAKKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSRSANEGYDALRDAYTDMLEAGILDPAKVTRSALESAASVAGLLLTTEALIAEIPEEKPAAAPAMPGAGMDY

SEQ ID NO: 7930 - protein, 326 aa, Chlamydia trachomatis
MVSQTVSVAVTGGTGQIAYSFLFSLAHGDVFGLDCGIDLRIYDIPGTERALSGVRMELDDGAFPLLQRVQVTTSLHDAFDGIDAAFLIGSVPRGPGMERRDLLKKNGEIFATQGKALNTTAKRDAKIFVVGNPVNTNCWIAMNHAPRLLRKNFHAMLRLDQNRMHSMLSHRAEVPLSAVSQVVVWGNHSAKQVPDFTQALINDRPIAETIADRDWLENIMVPSVQSRGSAVIEARGKSSAASAARALAEAARSIYQPKEGEWFSSGVCSDHNPYGLPEDLIFGFPCRMLATGEYEVIPRLPWDAFIRGKMQISLDEILQEKASVSL

SEQ ID NO: 7931 - protein, 465 aa, Chlamydia trachomatis
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIAGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 7932 - protein, 609 aa, Chlamydia trachomatis
MGFWRTSIMKMNRIWLLLLTFSSAIHSPVQGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 7933 - protein, 264 aa, Chlamydia trachomatis
MGNSGFYLYNTENCVFADNIKVGQMTEPLKDQQIILGTKSTPVAAKMTASDGISLTVSNNSSTNASITIGLDAEKAYQLILEKLGNQILDGIADTIVDSTVQDILDKITTDPSLGLLKAFNNFPITNKIQCNGLFTPSNIETLLGGTEIGKFTVTPKSSGSMFLVSADIIASRMEGGVVLALVREGDSKPCAISYGYSSGVPNLCSLRTSITNTGLTPTTYSLRVGGLESGVVWVNALSNGNDILGITNTSNVSFLEVIPQTNA

SEQ ID NO: 7934 - protein, 497 aa, Chlamydia trachomatis
MMKRLLCVLLSTSVFSSPMLGYSASKKDSKADICLAVSSGDQEVSQEDLLKEVSRGFSRVAAKATPGVVYIENFPKTGNQAIASPGNKRGFQENPFDYFNDEFFNRFFGLPSHREQQRPQQRDAVRGTGFIVSEDGYVVTNHHVVEDAGKIHVTLHDGQKYTAKIVGLDPKTDLAVIKIQAEKLPFLTFGNSDQLQIGDWAIAIGNPFGLQATVTVGVISAKGRNQLHIVDFEDFIQTDAAINPGNSGGPLLNINGQVIGVNTAIVSGSGGYIGIGFAIPSLMAKRVIDQLISDGQVTRGFLGVTLQPIDSELATCYKLEKVYGALVTDVVKGSPAEKAGLRQEDVIVAYNGKEVESLSALRNAISLMMPGTRVVLKIVREGKTIEIPVTVTQIPTEDGVSALQKMGVRVQNITPEICKKLGLAADTRGILVVAVEAGSPAASAGVAPGQLILAVNRQRVASVEELNQVLKNSKGENVLLMVSQGDVVRFIVLKSDE

SEQ ID NO: 7935 - protein, 393 aa, Chlamydia trachomatis
MKKLLKSVLVFAALSSASSLQALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 7936 - protein, 273 aa, Chlamydia trachomatis
MTTPTLIVTPPSPPAPSYSANRVPQPSLMDKIKKIAAIASLILIGTIGFLALLGHLVGFLIAPQITIVLLALFIISLAGNALYLQKTANLHLYQDLQREVGSLKEINFMLSVLQKEFLHLSKEFATTSKDLSAVSQDFYSCLQGFRDNYKGFESLLDEYKNSTEEMRKLFSQEIIADLKGSVASLREEIRFLTPLAEEVRRLAHNQQSLTVVIEELKTIRDSLRDEIGQLSQLSKTLTSQIALQRKESSDLCSQIRETLSSPRKSASPSTKSS

SEQ ID NO: 7937 - protein, 264 aa, Chlamydia trachomatis
MTTLPNNCTSNSNSINTFTKDIEMAKQIQGSRKDPLAKTSWIAGLICVVAGVLGLLAIGIGGCSMASGLGLIGAIVAAVIVAVGLCCLVSALCLQVEKSQWWQKEFESWIEQKSQFRIVMADMLKANRKLQSEVEFLSKGWSDDTAVHKEDVTKYEQVVEEYAEKIMELYEETGVLTIEKINLQKEKKAWLEEKAEMEQKLTTVTDLEAAKQQLEEKVTDLESEKQELREELDKAIENLDEMAYEAMEFEKEKHGIKPGRRGSI

SEQ ID NO: 7938 - protein, 163 aa, Chlamydia trachomatis
MRFLLALFSLILVLPATEAFSTEDKQCQQEAEEDCSQVADTCVFYSYAEGLEHARDEGKLTLVVLLDTSGYSFETLADAAHAMESSLLSTFADFVVLSRREAVPLIYPPVPDPMVGEIALFLEAFSDQTFPSQPVIVTLAIGASSAEIMDITEIPSINPEFVE

SEQ ID NO: 7939 - protein, 832 aa, Chlamydia trachomatis
MNRIHRTQGSLTDYNSTLEAIAKKIAKPDSATIVSQVAQYEQFKMEQEALKALLVSFDQKADQRYRNLIQRLEQLDVDRQTGRSTESQHIQEKPMASLQSENQVVAQAVVQSDSSMPIFTGIKQSWAVRLVQGIREILDQVLVDTSLFTEEERGDLLAIRMDAASLQDKQERLSTEDIRSLLSLSNDVMRVLQKASVSSTRQLELIQSLIDIFGTEENLEQSFAQVRLENFQAILSVIKERLTEEEFRVFQEVSEEISSIQRTSESHLSPEHIEAIARVGGHLSAKIVESELKASQKVDLCQRIAAMYQEQVDAVQAYHSLEQDALFVNSRQHSHFVQVISLVSSLMHSLSPTSEEERILLNPAMMVSVLPTVRAIGLRFDFLTAEQQQMVNAAVSSLQQQQLDEFLGVLCAHLVVVNCQNKETGLLEGLEESFSETLSGLSNNFVLTAKMQDILQVCSLQGFVTLANGDRYELFSYNDSGEAVCDEIALGDGFHKVLGTMLAVALSQAEVFKQECDRFILQADSEKNMIHKRMVQGEQKSLFLTKMQTELNAGKTIAQTKEVEASPLPSAVASVLIDHYMPKEVEFLEKISSRLYYGNKGSDIGNTILDAISLYVNSATYFGFANYIGQPPVVGKTRENIFAGSADNAKAKLDEEKKQVDVFLEITEAAKTTVTNQQSAVTNDDKLSTEQKAKIKAELTQYTDMLNAISNSLTSLKTQLAPLSVSTVEGVDGVFEVKNGIPGENGKNWRLVLQTLEDTVVSGEVGSPTNIGMFQMQALVHLNQQAYADMGQNFQLELQMHLTSMQQEWMVVATSLQLLNQIYLGLARNLLR

SEQ ID NO: 7940 - protein, 647 aa, Chlamydia trachomatis
MESGPESVSSNQSSMNPIINGQIASNSETKESTKESEASPSASSSVSSWSFLSSAKHALISLRDAILNKNSSPTDSLSQLEASTSTSTVTRVAARDYNEAKSNFDTAKSGLENATTLAEYETKMADLMAALQDMERLAKQKAEVTRIKEALQEKQEVIDKLNQLVKLEKQNQTLKETLTTTDSADQIPAINSQLEINKNSADQIIKDLEGQNISYEAVLTNAGEVIKASSEAGIKLGQALQSIVDAGDQSQAAVLQAQQNNSPDNIAATKKLIDAAETKVNELKQEHTGLTDSPLVKKAEEQISQAQKDIQEIKPSGSDIPIVGPSGSAASAGSAVGALKSSNNSGRISLLLDDVDNEMAAIAMQGFRSMIEQFNVNNPATAKELQAMEAQLTAMSDQLVGADGELPAEIQAIKDALAQALKQPSTDGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQVNQEEIMQKLTASISKAPQFGYPAVQNSADSLQKFAAQLEREFVDGERSLAESRENAFRKQPAFIQQVLVNIASLFSGYLS

What is claimed is:

1. A method of identifying an infertile female subject for whom in vitro fertilization or surgical repair of fallopian tube damage is indicated to treat the subject's infertility, comprising:
    (a) contacting a biological sample from the subject with a diagnostic panel comprising an antigen of each of Chlamydia trachomatis CT443 or an immunologically reactive fragment thereof, Chlamydia trachomatis CT381 or an immunologically reactive fragment thereof, and Chlamydia trachomatis CT875 or an immunologically reactive fragment thereof;
    (b) detecting formation of an antigen/antibody complex with each of the antigen of Chlamydia trachomatis CT443 or an immunologically reactive fragment thereof and the antigen of Chlamydia trachomatis CT381 or an immunologically reactive fragment thereof and detecting the absence of formation of an antigen/antibody complex with the antigen of Chlamydia trachomatis CT875 or an immunologically reactive fragment thereof in the sample, wherein the detection of an antigen/antibody complex with each of the antigen of Chlamydia trachomatis CT443 or an immunologically reactive fragment thereof and the antigen of Chlamydia trachomatis CT381 or an immunologically reactive fragment thereof and detection of the absence of formation of an antigen/antibody complex with the antigen of Chlamydia trachomatis CT875 or an immunologically reactive fragment thereof in the sample identifies the subject as having tubal factor infertility, thereby identifying the subject as a subject for whom in vitro fertilization or surgical repair of fallopian tube damage is indicated to treat the subject's infertility; and
    (c) treating the subject identified in step (b) as having tubal factor infertility by in vitro fertilization or surgical repair of fallopian tube damage.

2. The method of claim 1, wherein the tubal factor infertility is caused by chlamydial infection.

3. The method of claim 1, wherein the subject is a human female.

4. The method of claim 1, wherein the biological sample is any body fluid in which antibodies can be detected.

5. The method of claim 1, wherein the biological sample is diluted 1:1000.

6. The method of claim 1, wherein the antigen of the CT443 protein or immunologically reactive fragment thereof is a C terminal fragment.

7. The method of claim 1, further comprising contacting the biological sample of (a) with an additional antigen selected from the group consisting of *Chlamydia trachomatis* HSP60 or an immunologically reactive fragment thereof, *Chlamydia trachomatis* CT376 or an immunologically reactive fragment thereof, *Chlamydia trachomatis* CT557 or an immunologically reactive fragment thereof and any combination thereof, and an antigen/antibody complex is detected in the sample for each of said additional antigen(s).

\* \* \* \* \*

UNITED STATES PATENT AND TRADEMARK OFFICE
CERTIFICATE OF CORRECTION

PATENT NO. : 9,046,530 B2
APPLICATION NO. : 13/691260
DATED : June 2, 2015
INVENTOR(S) : Zhong Page 1 of 1

It is certified that error appears in the above-identified patent and that said Letters Patent is hereby corrected as shown below:

In the Specification:
Column 16, Line 16: Please correct "(ETA)," to read -- (EIA), --
Column 20, Line 32: Please correct "304 ml" to read -- 30 µg/ml --
Column 144, Table 6 Notes, Line 24: Please correct "CT681 (14014P)," to read -- CT681 (MOMP), --

Signed and Sealed this
Seventeenth Day of May, 2016

Michelle K. Lee
*Director of the United States Patent and Trademark Office*